(12) United States Patent
Ståhl et al.

(10) Patent No.: US 11,098,096 B2
(45) Date of Patent: Aug. 24, 2021

(54) ALZHEIMER Aβ PEPTIDE BINDING POLYPEPTIDE

(71) Applicant: Amylonix AB, Johanneshov (SE)

(72) Inventors: Stefan Ståhl, Stockholm (SE); John Löfblom, Tullinge (SE); Hanna Lindberg, Stockholm (SE); Torleif Härd, Uppsala (SE)

(73) Assignee: AMYLONIX AB, Johanneshov (SE)

( * ) Notice: Subject to any disclaimer, the term of this patent is extended or adjusted under 35 U.S.C. 154(b) by 0 days.

(21) Appl. No.: 16/715,798

(22) Filed: Dec. 16, 2019

(65) Prior Publication Data

US 2020/0172588 A1 Jun. 4, 2020

Related U.S. Application Data

(63) Continuation of application No. 15/548,208, filed as application No. PCT/EP2016/053665 on Feb. 22, 2016, now abandoned.

(30) Foreign Application Priority Data

Feb. 20, 2015 (EP) .................................... 15156018
Sep. 16, 2015 (EP) .................................... 15185461

(51) Int. Cl.
  *C07K 14/47* (2006.01)
  *A61K 38/00* (2006.01)

(52) U.S. Cl.
  CPC .......... *C07K 14/4711* (2013.01); *A61K 38/00* (2013.01); *C07K 2317/92* (2013.01)

(58) Field of Classification Search
  None
  See application file for complete search history.

(56) References Cited

U.S. PATENT DOCUMENTS

| | | | |
|---|---|---|---|
| 8,333,973 B2 | 12/2012 | Muzykantov et al. | |
| 8,822,648 B2 | 9/2014 | Cianfriglia et al. | |
| 2009/0259026 A1 | 10/2009 | Tomlinson et al. | |
| 2010/0316564 A1 | 12/2010 | Sigurdsson | |

FOREIGN PATENT DOCUMENTS

WO    2005075507    8/2005

OTHER PUBLICATIONS

C. Gronwall et al., "Selection and Characterization of Affibody Ligands Binding to Alzheimer Amyloid B Peptides;" Journal of Biotechnology; 2007, pp. 162-183, vol. 128.
Final Office Action for U.S. Appl. No. 15/548,208, filed Aug. 2, 2017; dated Jun. 19, 2019.
Hoyer et al.; "Interaction of Alzheimer's Aβ Peptide with an Engineered Binding Protein—Thermodynamics and Kinetics of Coupled Folding-Binding"; J. Mol. Biol., vol. 378; 2008; pp. 398-411.
International Search Report for International Application No. PCT/EP2016/053665; Date of Filing: Feb. 22, 2016; dated May 3, 2016; 5 pages.
Kussie, Paul H., et al., "A Single Engineered Amino Acid Substitution Changes Antibody Fine Specificity", J Immunol 152(1): pp. 146-152.
Lindberg et al.; "Staphylococcal display for combinatorial protein engineering of a head-to-tail affibody dimer binding the Alzheimer amyloid-β peptide"; Biotechnol. J., vol. 8; 2013; pp. 139-145.
Lofblom et al., "Affibody Molecules: Engineered Proteins for Therapeutic, Diagnostic and Biotechnological Applications", FEBS Letters; 584; (2010); pp. 2670-2680.
Luheshi et al.; "Sequestration of the Aβ Peptide Prevents Toxicity and Promotes Degradation In Vivo"; PLOS Biol., vol. 8, No. 3; 2010; pp. 1-9.
Non Final Office Action for U.S. Appl. No. 15/548,208, filed Aug. 2, 2018; dated Sep. 18, 2018; 29 pages.
Non Final Office Action for U.S. Appl. No. 15/548,208, filed Aug. 2, 2017; dated Sep. 18, 2018; 29 pages.
Written Opinion of the International Searching Authority for International Application No. PCT/EP2016/053665; Date of Filing: Feb. 22, 2016; dated May 3, 2016; 7 pages.

*Primary Examiner* — Adam Weidner
(74) *Attorney, Agent, or Firm* — Cantor Colburn LLP

(57) ABSTRACT

The present disclosure relates to a class of engineered polypeptides having a binding affinity for amyloid β (Aβ) peptides (in the following referred to as Aβ), comprising the amino acid sequence $EX_2X_3YX_5X_6NLX_9AX_{11}QLCAX_{16}IX_{18}X_{19}X_{20}ED$ (SEQ ID NO:632). The present disclosure also relates to the use of such Aβ peptide binding polypeptides as therapeutic, prognostic and/or diagnostic agents.

14 Claims, 43 Drawing Sheets

Specification includes a Sequence Listing.

FIG. 1A

| NAME | SEQUENCE | SEQ ID NO: |
|---|---|---|
| ABPP001 | AGGETVYFPNLNADQLCAFIRSLEDDPSQSANLLAEAKKLNDAQAPASSSSGSSSSGRASAGRERVYLPNLNADQLCAFIQSLE DDPSQQANLLAEAKKLNDAQAPK | 1 |
| ABPP002 | AGGETVYFPNLNADQLCAFIRSLEDDPSQSANLLAEAKKLNDAQAPASSSSGSSSSGRASAGRERVYLPNLNADQLCAFIRSLE DDPSQSANLLAEAKKLNDAQAPK | 2 |
| ABPP003 | AGGETVYFPNLNADQLCAFIQSLEDDPSQSANLLAEAKKLNDAQAPASSSSGSSSSGRASAGRERVYLPNLNADQLCAFIRSLE DDPSQSANLLAEAKKLNDAQAPK | 3 |
| ABPP004 | AGGETVYFPNLNAHQLCAFIRSLEDDPSQSANLLAEAKKLNDAQAPASSSSGSSSSGRASAGRERVYLPNLNAHQLCAFIQSLE DDPSQSANLLAEAKKLNDAQAPK | 4 |
| ABPP005 | AGGETVYFPNLNADQLCAFIRSLEDDPSQSANLLAEAKKLNDAQAPASSSSGSSSSGRASAGRERVYLPNLNAHQLCAFINSLE DDPSQSANLLAEAKKLNDAQAPK | 5 |
| ABPP006 | AGGETVYFPNLNADQLCAFIQSLEDDPSQQANLLAEAKKLNDAQAPASSSSGSSSSGRASAGRERVYLPNLNADQLCAFIRSLE DDPSQQANLLAEAKKLNDAQAPK | 6 |
| ABPP007 | AGGETVYFPNLNADQLCAFIQSLEDDPSQQANLLAEAKKLNDAQAPASSSSGSSSSGRASAGRERVYLPNLNADQLCAFIRSRE DDPSQQANLLAEAKKLNDAQAPK | 7 |
| ABPP008 | AGGETVYFPNLNADQLCAFINSLEDDPSQQANLLAEAKKLNDAQAPASSSSGSSSSGRASAGRERVYLPNLNAHQLCAFIRSLE DDRSQQANLLAEAKKLNDAQAPK | 8 |
| ABPP009 | AGGETVYFPNLNADQLCAFIQSLEDDPSQSANLLAEAKKLNDAQAPASSSSGSSSSGRASAGRERVYLPNLNAHQLCAFIQSLE DDPSQSANLLAEAKKLNDAQAPK | 9 |
| ABPP010 | AGGETVYFPNLNAHQLCAFIRSLEDDPSQSANLLAEAKKLNDAQAPASSSSGSSSSGRASAGRERVYLPNLNADQLCAFIRSLE DDPSQSANLLAEAKKLNDAQAPK | 10 |
| ABPP011 | AGGETVYFPNLNADQLCAFIRSLEDDPSQQANLLAEAKKLNDAQAPASSSSGSSSSGRASAGRERVYLPNLNAHQLCAFIRSLE DDPSQQANLLAEAKKLNDAQAPK | 11 |
| ABPP012 | AGGETVYFPNLNADQLCAFIQSLEDDPSQQANLLAEAKKLNDAQAPASSSSGSSSSGRASAGRERVYLPNLNAHQLCAFIQSLE DDPSQQANLLAEAKKLNDAQAPK | 12 |
| ABPP013 | AGGETVYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 13 |
| ABPP014 | AGGETVYFPNLNADQLCAFINSLEDDPSQQANLLAEAKKLNDAQAPASSSSGSSSSGRASAGRERVYLPNLNADQLCAFINSLE DDPSQQANLLAEAKKLNDAQAPK | 14 |
| ABPP015 | AGGERVYLPNLNADQLCAFIQSLEDDPSQSANLLAEAKKLNDAQAPASSSSGSSSSGRASAGRERVYLPNLNAHQLCAFIRSLE DDPSQSANLLAEAKKLNDAQAPK | 15 |
| ABPP016 | AGGETVYFPNLNAHQLCAFIRSLEDDPSQSANLLAEAKKLNDAQAPASSSSGSSSSGRASAGRERVYLPNLNAHQLCAFIRSLE DDPSQSANLLAEAKKLNDAQAPK | 16 |
| ABPP017 | AGGETVYFPNLNAHQLCAFIQSLEDDPSQSANLLAEAKKLNDAQAPASSSSGSSSSGRASAGRERVYLPNLNAHQLCAFIRSLE DDPSQQANLLAEAKKLNDAQAPK | 17 |
| ABPP018 | AGGETVYFPNLNAHQLCAFIRSLEDDPSQQANLLAEAKKLNDAQAPASSSSGSSSSGRASAGRERVYLPNLNADQLCAF TRSLEDDQSQRANLLAEAKKLNDAQAPK | 18 |
| ABPP019 | AGGETVYFPNLNADQLCAFIQSLEDDPSQQANLLAEAKKLNDAQAPASSSSGSSSSGRASAGRERVYLPNLNAHQLCAFIRSLE DDPSQSANLLAEAKKLNDAQAPK | 19 |
| ABPP020 | AGGETVYFPNLNADQLCAFIQSLEDDPSQSANLLAEAKKLNDAQAPASSSSGSSSSGRASAGRERVYLPNLNAHQLCAFINSLE DDPSQSANLLAEAKKLNDAQAPK | 20 |
| ABPP021 | AGGETVYFPNLNAHQLCAFIQSLEDDPSQSANLLAEAKKLNDAQAPASSSSGSSSSGRASAGRERVYLPNLNADQLCAFIQSLE DDPSQSANLLAEAKKLNDAQAPK | 21 |
| ABPP022 | AGGETVYFPNLNADQLCAFIQSLEDDPSQSANLLAEAKKLNDAQAPASSSSGSSSSGRASAGRERVYLPNLNADQLCAFIRSLE DDPSQSANLLAEAKKLNDAQAPK | 22 |
| ABPP023 | AGGETVYLPNLNADQLCAFIRSLEDDPSQSANLLAEAKKLNDAQAPASSSSGSSSSGRASAGRERVYLPNLNAHQLCAFIRSLE DDQSQSANLLAEAKKLNDAQAPK | 23 |
| ABPP024 | AGGETVYLPNLNAHQLCAFIRSLEDDPSQSANLLAEAKKLNDAQAPASSSSGSSSSGRASAGRERVYLPNLNAHQLCAFIQSLE DDPSQSANLLAEAKKLNDAQAPK | 24 |

FIG. 1B

| NAME | SEQUENCE | SEQ ID NO: |
|---|---|---|
| ABPP025 | AGGERVYLPNLNAHQLCAFIRSLEDDPSQSANLLAEAKKLNDAQAPASSSSGSSSSGRASAGRERVYLPNLNADQLCAFIRSLE DDPSQSANLLAEAKKLNDAQAPK | 25 |
| ABPP026 | AGGEIVYFPNLNAHQLCAFIRSLEDDPSQSANLLAEAKKLNDAQAPASSSSGSSSSGRASAGRERVYLPNLNADQLCAFINSLE DDPSQQANLLAEAKKLNDAQAPK | 26 |
| ABPP027 | AGGERVYLPNLNAHQLCAFINSLEDDPSQSANLLAEAKKLNDAQAPASSSSGSSSSGRASAGRERVYLPNLNAHQLCAFIQSLE DDPSQSANLLAEAKKLNDAQAPK | 27 |
| ABPP028 | AGGEIVYFPNLNADQLCAFIQSLEDDPSQSANLLAEAKKLNDAQAPASSSSGSSSSGRASAGRERVYLPNLNAHQLCAFISLE DDPSQSANLLAEAKKLNDAQAPK | 28 |
| ABPP029 | AGGEIVYFPNLNADQLCAFIRSLEDDPSQSANLLAEAKKLNDAQAPASSSSGSSSSGRASAGRERVYLPNLNADQLCAFIQSLE DDPSQQANLLAEAKKLNDAQAPK | 29 |
| ABPP030 | AGGEIVYFPNLNAHQLCAFIRSLEDDPSQSANLLAEAKKLNDAQAPASSSSGSSSSGRASAGRERVYLPNLNAHQLCAFIQSLE DDPSQSANLLAEAKKLNDAQAPK | 30 |
| ABPP031 | AGGEIVYFPNLNAHQLCAFIRSLEDDPSQQANLLAEAKKLNDAQAPASSSSGSSSSGRASAGRERVYLPNLNADQLCAFIRSLE DDQSQQANLLAEAKKLNDAQAPK | 31 |
| ABPP032 | AGGEIVYFPNLNADQLCAFIQSLEDDPSQQANLLAEAKKLNDAQAPASSSSGSSSSGRASAGRERVYLPNLNAHQLCAFIQSLE DDPSQQANLLAEAKKLNDAQAPK | 32 |
| ABPP033 | AGGEIVYFPNLNADQLCAFIQSLEDDPSQQANLLAEAKKLNDAQAPASSSSGSSSSGRASAGRERVYLPNLNADQLCAFIRSLE DDPSQSANLLAEAKKLNDAQAPK | 33 |
| ABPP034 | AGGEIVYFPNLNADQLCAFIRSLEDDPSQQANLLAEAKKLNDAQAPASSSSGSSSSGRASAGRETVYLPNLNADQLCAFIRSLE DDPSQSANLLAEAKKLNDAQAPK | 34 |
| ABPP035 | AGGERVYLPNLNAHQLCAFIRSLEDDPSQQANLLAEAKKLNDAQAPASSSSGSSSSGRASAGRERVYLPNLNADQLCAFIQSLE DDPSQSANLLAEAKKLNDAQAPK | 35 |
| ABPP036 | AGGEIVYFPNLNAHQLCAFIRSLEDDPSQSANLLAEAKKLNDAQAPASSSSGSSSSGRASAGRERVYLPNLNADQLCAFIQSLE DDPSQQANLLAEAKKLNDAQAPK | 36 |
| ABPP037 | AGGEIVYFPNLNADQLCAFIQSLEDDPSQSANLLAEAKKLNDAQAPASSSSGSSSSGRASAGRERVYLPNLNADQLCAFIRSLE DDPSQSANLLAEAKKLNDAQAPK | 37 |
| ABPP038 | AGGEIVYFPNLNADQLCAFIRSLEDDPSQSANLLAEAKKLNDAQAPASSSSGSSSSGRASAGRERVYLPNLNADQLCAFIRSLE DDPSQRANLLAEAKKLNDAQAPK | 38 |
| ABPP039 | AGGEIVYFPNLNADQLCAFIRSLEDDPSQSANLLAEAKKLNDAQAPASSSSGSSSSGRASAGRERVYLPNLNAHQLCAFIRSLE DDPSQQANLLAEAKKLNDAQAPK | 39 |
| ABPP040 | AGGEIVYFPNLNAHQLCAFIQSLEDDPSQQANLLAEAKKLNDAQAPASSSSGSSSSGRASAGRERVYLPNLNADQLCAFIRSLE DDPSQSANLLAEAKKLNDAQAPK | 40 |
| ABPP041 | AGGEIVYFPNLNADQLCAFIQSLEDDPSQQANLLAEAKKLNDAQAPASSSSGSSSSGRASAGRERVYLPNLNADQLCAFIRSLE DDPSQQANLLAEAKKLNDAQAPK | 41 |
| ABPP042 | AGGEIVYFPNLNADQLCAFIRSLEDDPSQQANLLAEAKKLNDAQAPASSSSGSSSSGRASAGRERVYLPNLNAHQLCAFIRSLE DDPSQSANLLAEAKKLNDAQAPK | 42 |
| ABPP043 | AGGEIVYFPNLNAHQLCAFIRSLEDDPSQRANLLAEAKKLNDAQAPASSSSGSSSSGRASAGRERVYLPNLNAHQLCAFIRSFE DDPSQSANLLAEAKKLNDAQAPK | 43 |
| ABPP044 | AGGEIVYFPNLNADQLCAFIRSLEDDPSQSANLLAEAKKLNDAQAPASSSSGSSSSGRASAGRERVYLPNLNAHQLCAFIRSIE DDPSQSANLLAEAKKLNDAQAPK | 44 |
| ABPP045 | AGGEIVYFPNLNADQLCAFIQSLEDDPSQSANLLAEAKKLNDAQAPASSSSGSSSSGRASAGRERVYLPNLNAHQLCAFIRSLE DDPSQSANLLAEAKKLNDAQAPK | 45 |
| ABPP046 | AGGERVYLTNLNADQLCAFINSLEDDPSQSANLLAEAKKLNDAQAPASSSSGSSSSGRASAGRERVYLPNLNADQLCAFIRSLE DDRSQQANLLAEAKKLNDAQAPK | 46 |
| ABPP047 | AGGEIVYFPNLNADQLCAFIRSLEDDPSQSANLLAEAKKLNDAQAPASSSSGSSSSGRASAGRERVYLPNLNADQLCAFIRSLE DDPSQQANLLAEAKKLNDAQAPK | 47 |
| ABPP048 | AGGEIVYFPNLNADQLCAFIRSLEDDPSQSANLLAEAKKLNDAQAPASSSSGSSSSGRASAGRERVYLPNLNADQLCAFIRSLE DDPSQQANLLAEAKKLNDAQAPK | 48 |

FIG. 1C

| NAME | SEQUENCE | SEQ ID NO: |
|---|---|---|
| ABPP049 | AGGERVYFTNLNADQLCAFIQSLEDDPSQSANLLAEAKKLNDAQAPASSSSGSSSSGRASAGRERVYLPNLNAHQLCAFIRSLE DDPSQQANLLAEAKKLNDAQAPK | 49 |
| ABPP050 | AGGETVYLPNLNADQLCAFIQSLEDDPSQSANLLAEAKKLNDAQAPASSSSGSSSSGRASAGRERVYLPNLNAHQLCAFIQSLE DDPSQQANLLAEAKKLNDAQAPK | 50 |
| ABPP051 | AGGERVYFPNLNADQLCAFIRSLEDDPSQQANLLAEAKKLNDAQAPASSSSGSSSSGRASAGRERVYLPNLNADQLCAFIRSLE DDRSQQANLLAEAKKLNDAQAPK | 51 |
| ABPP052 | AGGERVYFPNLNADQLCAFIRSLEDDPSQQANLLAEAKKLNDAQAPASSSSGSSSSGRASAGRERVYLPNLNADQLCAFIQSLE DDPSQQANLLAEAKKLNDAQAPK | 52 |
| ABPP053 | AGGERVYFPNLNADQLCAFIRSLEDDPSQSANLLAEAKKLNDAQAPASSSSGSSSSGRASAGRERVYLPNLNADQLCAFIRSLE DDRSQQANLLAEAKKLNDAQAPK | 53 |
| ABPP054 | AGGERVYIPNLNADQLCAFIRSLEDDPSQSANLLAEAKKLNDAQAPASSSSGSSSSGRASAGRERVYLPNLNADQLCAFIQSLE DDPSQSANLLAEAKKLNDAQAPK | 54 |
| ABPP055 | AGGETVYFPNLNADQLCAFIRSLEDDPSQSANLLAEAKKLNDAQAPASSSSGSSSSGRASAGGEIVYFPNLNADQLCAFIQSLE DDPSQQANLLAEAKKLNDAQAPK | 55 |
| ABPP056 | AGGERVYFTNLNADQLCAFIQSLEDDPSQQANLLAEAKKLNDAQAPASSSSGSSSSGRASAGRERVYLPNLNADQLCAFIRSLE DDRSQQANLLAEAKKLNDAQAPK | 56 |
| ABPP057 | AGRERVYFPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 57 |
| ABPP058 | AGGERVYFPNLNADQLCAFIQSLEDDPSQQANLLAEAKKLNDAQAPASSSSGSSSSGRASAGGERVYFPNLNAHQLCAFIQSLE DDPSQSANLLAEAKKLNDAQAPK | 58 |
| ABPP059 | AGGERVYLPNLNADQLCAFIRSLEDDPSQSANLLAEAKKLNDAQAPASSSSGSSSSGRASAGRERVYLPNLNADQLCAFIRSLE DDPSQSANLLAEAKKLNDAQAPK | 59 |
| ABPP060 | AGGETVYFPNLNADQLCAFIRSLEDDPSQQANLLAEAKKLNDAQAPASSSSGSSSSGRASAGGEIVYFPNLNADQLCAFIRSLE DDPSQQANLLAEAKKLNDAQAPK | 60 |
| ABPP061 | AGGETVYFPNLNADQLCAFIRSLEDDPSQSANLLAEAKKLNDAQAPASSSSGSSSSGRASAGGEIVYFPNLNAHQLCAFIRSLE DDPSQSANLLAEAKKLNDAQAPK | 61 |
| ABPP062 | AGRERVYFPNLNADQLCAFIRSLEDDPSQQANLLAEAKKLNDAQAPASSSSGSSSSGRASAGGEIVYFPNLNADQLCAFINSLE DDPSQSANLLAEAKKLNDAQAPK | 62 |
| ABPP063 | AGGETVYFPNLNADQLCAFINSLEDDPSQSANLLAEAKKLNDAQAPASSSSGSSSSGRASAGGEIVYFPNLNADQLCAFIQSLE DDPSQSANLLAEAKKLNDAQAPK | 63 |
| ABPP064 | AGRERVYFPNLNADQLCAFIRSLEDDPSQSANLLAEAKKLNDAQAPASSSSGSSSSGRASAGGERVYLPNLNAHQLCAFIQSLE DDPSQSANLLAEAKKLNDAQAPK | 64 |
| ABPP065 | AGGETVYFPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 65 |
| ABPP066 | AGGERVYFPNLNAHQLCAFIQSLEDDPSQQANLLAEAKKLNDAQAPASSSSGSSSSGRASAGRERVYLPNLNAHQLCAFIRSLE DDPSQRANLLAEAKKLNDAQAPK | 66 |
| ABPP067 | AGGETVYFPNLNADQLCAFIRSLEDDPSQSANLLAEAKKLNDAQAPASSSSGSSSSGRASAGGEIVYLPNLNAHQLCAFIRSLE DDPSQSQNLLAEAKKLNDAQAPK | 67 |
| ABPP068 | AGGETVYFPNLNADQLCAFINSLEDDPSQSANLLAEAKKLNDAQAPASSSSGSSSSGRASAGGEMVYFPNLNADQLCAFIRSLE DDPSQSANLLAEAKKLNDAQAPK | 68 |
| ABPP069 | AGGETVYFPNLNADQLCAFIRSLEDDPSQQANLLAEAKKLNDAQAPASSSSGSSSSGRASAGGERVYLPNLNAHQLCAFIQSLE DDPSQSANLLAEAKKLNDAQAPK | 69 |
| ABPP070 | AGRERVYFPNLNADQLCAFIRSLEDDPSQSANLLAEAKKLNDAQAPASSSSGSSSSGRASAGRERVYLPNLNADQLCAFIQSLE DDPSQSANLLAEAKKLNDAQAPK | 70 |
| ABPP071 | AGGETVYLPNLNADQLCAFINSLEDDPSQSANLLAEAKKLNDAQAPASSSSGSSSSGRASAGGEIVYFPNLNADQLCAFIQSLE DDPSQSANLLAEAKKLNDAQAPK | 71 |
| ABPP072 | AGRERVYLPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 72 |

FIG. 1D

| NAME | SEQUENCE | SEQ ID NO: |
|---|---|---|
| ABPP073 | AGGERVYLPNLNAHQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 73 |
| ABPP074 | AGGERVYFPNLNADQLCAFIRSLEDDPSQSANLLAEAKKLNDAQAPASSSSGSSSSGRASAGGERVYLPNLNADQLCAFIRSLE DDPSQQANLLAEAKKLNDAQAPK | 74 |
| ABPP075 | AGGEIVYFPNLNADQLCAFIQSLEDDPSQSANLLAEAKKLNDAQAPASSSSGSSSSGRASAGGERVYLPNLNADQLCAFIRSLE DDPSQSANLLAEAKKLNDAQAPK | 75 |
| ABPP076 | AGGERVYLPNLNAHQLCAFIRSLEDDPSQSANLLAEAKKLNDAQAPASSSSGSSSSGRASAGGERVYLPNLNADQLCAFIRSLE DDPSQQANLLAEAKKLNDAQAPK | 76 |
| ABPP077 | AGGEIVYFPNLNADQLCAFIQSLEDDPSQQANLLAEAKKLNDAQAPASSSSGSSSSGRASAGGEIVYLPNLNADQLCAFIRSLE DDPSQQANLLAEAKKLNDAQAPK | 77 |
| ABPP078 | AGGERVYLPNLNAHQLCAFIRSLEDDPSQSANLLAEAKKLNDAQAPASSSSGSSSSGRASAGGEIVYLPNLNAHQLCAFIQSLE DDPSQSANLLAEAKKLNDAQAPK | 78 |
| ABPP079 | AGGEIVYLPNLNAHQLCAFIQSLEDDPSQSANLLAEAKKLNDAQAPASSSSGSSSSGRASAGGERVYLPNLNADQLCAFIRSLE DDPSQSANLLAEAKKLNDAQAPK | 79 |
| ABPP080 | AGGEIVYFPNLNADQLCAFIQSLEDDPSQSANLLAEAKKLNDAQAPASSSSGSSSSGRASAGGERVYLPNLNADQLCAFIRSLE DDPSQQANLLAEAKKLNDAQAPK | 80 |
| ABPP081 | AGGETVYFPNLNADQLCAFIRSLEDDPSQQANLLAEAKKLNDAQAPASSSSGSSSSGRASAGGEIVYLPNLNAHQLCAFIQSLE DDPSQSANLLAEAKKLNDAQAPK | 81 |
| ABPP082 | AGGERVYFPNLNADQLCAFIRSLEDDSSQSANLLAEAKKLNDAQAPASSSSGSSSSGRASAGGEIVYFPNLNADQLCAFIQSLE DDPSQSANLLAEAKKLNDAQAPK | 82 |
| ABPP083 | AGGERVYFPNLNADQLCAFIRSLEDDPSQQAKLLAEAKKLNDAQAPASSSSGSSSSGRASAGRERVYLPNLNADQLCAFIRSLE DDPSQSANLLAEAKKLNDAQAPK | 83 |
| ABPP084 | AGGERVYFPNLNADQLCAFIQSLEDDPSQSANLLAEAKKLNDAQAPASSSSGSSSSGRASAGGEIVYFPNLNADQLCAFIRSLE DDRSQRANLLAEAKKLNDAQAPK | 84 |
| ABPP085 | AGGEIVYFPNLNADQLCAFIRSLEDDPSQNANLLAEAKKLNDAQAPASSSSGSSSSGRASAGGEIVYLPNLNADQLCAFIRSLE DDPSQSANLLAEAKKLNDAQAPK | 85 |
| ABPP086 | AGGERVYFPNLNADQLCAFIRSLEDDPSQSANLLAEAKKLNDAQAPASSSSGSSSSGRASAGGEIVYLPNLNADQLCAFIRSLE DDPSQSANLLAEAKKLNDAQAPK | 86 |
| ABPP087 | AGGETVYFPNLNADQLCAFIQSLEDDPSQQANLLAEAKKLNDAQAPASSSSGSSSSGRASAGRERVYLPNLNADQLCAFIRSLE DDPSQSANLLAEAKKLNDAQAPK | 87 |
| ABPP088 | AGGETVYFPNLNADQLCAFIQSLEDDPSQQANLLAEAKKLNDAQAPASSSSGSSSSGRASAGGEIVYFPNLNADQLCAFIRSLE DDPSQSANLLAEAKKLNDAQAPK | 88 |
| ABPP089 | AGGERVYLPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 89 |
| ABPP090 | AGGERVYLPNLNADQLCAFIQSLEDDPSQSANLLAEAKKLNDAQAPASSSSGSSSSGRASAGGEMVYLPNLNADQLCAFIRSLE DDPSQSANLLAEAKKLNDAQAPK | 90 |
| ABPP091 | AGGERVYFPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 91 |
| ABPP092 | AGGERVYFPNLNADQLCAFIRSLEDDPSQNANLLAEAKKLNDAQAPASSSSGSSSSGRASAGGEQVYLPNLNADQLCAFIRSLE DDPSQSANLLAEAKKLNDAQAPK | 92 |
| ABPP093 | AGGERVYLPNLNADQLCAFIRSLEDDSSQSANLLAEAKKLNDAQAPASSSSGSSSSGRASAGGEIVYFPNLNADQLCAFIRSLE DDPSQSANLLAEAKKLNDAQAPK | 93 |
| ABPP094 | AGGETVYFPNLNADQLCAFIRSLEDDPSQSANLLAEAKKLNDAQAPASSSSGSSSSGRASAGGEQVYLPNLNADQLCAFIRSLE DDPSQSANLLAEAKKLNDAQAPK | 94 |
| ABPP095 | AGGERVYLPNLNADQLCAFIRSLEDDPSQSANLLAEAKKLNDAQAPASSSSGSSSSGRASAGRERVYLPNLNADQLCAFIRSLE DDPSQSANLLAEAKKLNDAQAPK | 95 |
| ABPP096 | AGGERVYFPNLNADQLCAFIQSLEDDPSQRANLLAEAKKLNDAQAPASSSSGSSSSGRASAGRERVYLPNLNADQLCAFIQSLE DDPSQSANLLAEAKKLNDAQAPK | 96 |

FIG. 1E

| NAME | SEQUENCE | SEQ ID NO: |
|---|---|---|
| ABPP097 | AGGEIVYLPNLNADQLCAFIRSLEDDPSQSANLLAEAKKLNDAQAPASSSSGRASAGGEIVYFPNLNADQLCAFIQSLE | 97 |
| ABPP098 | AGGEIVYLPNLNAHQLCAFIRSLEDDPSQSANLLAEAKKLNDAQAPASSSSGRASAGGEIVYLPNLNADQLCAFIQSLE DDPSQSANLLAEAKKLNDAQAPK | 98 |
| ABPP099 | AGGEIVYFPNLNADQLCAFIRSLEDDPSQSANLLAEAKKLNDAQAPASSSSGRASAGRERVYLPNLNADQLCAFIQSLE DDPSQSANLLAEAKKLNDAQAPK | 99 |
| ABPP100 | AGGEIVYFPNLNADQLCAFIRSLEDDPSQSANLLAEAKKLNDAQAPASSSSGRASAGGEIVYFPNLNADQLCAFIQSLE DDPSQSANLLAEAKKLNDAQAPK | 100 |
| ABPP101 | AGRERVYFPNLNADQLCAFIRSLEDDPSQSANLLAEAKKLNDAQAPASSSSGRASAGGEIVYFPNLNADQLCAFIRSLE DDPSQSANLLAEAKKLNDAQAPK | 101 |
| ABPP102 | AGGEIHYFPNLNADQLCAFIRSLEDDPSQSANLLAEAKKLNDAQAPASSSSGRASAGGERVYLPNLNADQLCAFIRSLE DDQSQQANLLAEAKKLNDAQAPK | 102 |
| ABPP103 | AGGEIVYFPNLNADQLCAFIRSLEDDPSQSANLLAEAKKLNDAQAPASSSSGSSSSGRASAGGEQVYLPNLNADQLCAFIRSLE DDPSQSANLLAEAKKLNDAQAPK | 103 |
| ABPP104 | AGGEIVYFPNLNADQLCAFINSLEDDPSQSANLLAEAKKLNDAQAPASSSSGSSSSGRASAGGEQVYLPNLNADQLCAFIRSLE DDPSQSANLLAEAKKLNDAQAPK | 104 |
| ABPP105 | AGRERVYLPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 105 |
| ABPP106 | AGRERVYLPNLNAHQLCAFIRSLEDDPSQSANLLAEAKKLNDAQAPASSSSGSSSSGRASAGRERVYLPNLNADQLCAFIRSLE DDPSQNANLLAEAKKLNDAQAPK | 106 |
| PPO13 | LAEAKEAANAELDSYGVSDFYKRLIDKAKTVEGVEALKDAILAALP | 107 |
| ZTaq | VDNKFKNELGWATWEIFNLPNLNGVQVHHQKLVFFAEDVGSNKGAIIGLMVGGVVIA | 108 |
| Aβ(1-42) | DAEFRHDSGYEVHHQKLVFFAEDVGSNKGAIIGLMVGGVVIA | 109 |
| Aβ(1-40) | DAEFRHDSGYEVHHQKLVFFAEDVGSNKGAIIGLMVGGV | 110 |
| ZAβ3 | VDNKFNKEMASAGGEIVYLPNLNPDQLCAFIHSLHDDPSQSANLLAEAKKLNDAQAPK | 111 |
| Z(Aβ3)2 | VDNKFNKEMASAGGEIVYLPNLNPDQLCAFIHSLHDDPSQSANLLAEAKKLNDAQAPKVDNKFNKEMASAGGEIVYLPNLNP DQLCAFIHSLHDDPSQSANLLAEAKKLNDAQAPK | 112 |
| Z(Aβ3A12)2 | AGGEIVYLPNLNPDQLCAFIHSLHDDPSQSANLLAEAKKLNDAQAPKSSSGFASAGGEIVYLPNLNPDQLCAFIHSLHDD PSQSANLLAEAKKLNDAQAPK | 113 |
| ABP | KLLDALAKAKADALKEFNKYGVSDYYKNLINNAKTVEGVKDLQAVVESAKKARISEATDGLSDFLKSQTPAEDTVKSIELAEEA KVLANRELDKYGVSDYYKNLINNAKTVEGVKDLQAVVESAKKARISEATDGLSDFLKSQTPAEDTVKSIELAEAKVLANRELD KYGVSDYYKNLINNAKTVEGVKALIDEILAALP | 114 |
| ABPP095-PPO13 | MAGGERVYLPNLNADQLCAFIRSLEDDPSQSANLLAEAKKLNDAQAPASSSSGSSSSGVSDFYKRLIDKAKTVEGVEALKDAIL AALP | 115 |
| (ZTaq)2-PPO13 | MGSSLQVDNKFNKELGWATWETFNLPNLNGVQVKAFIDSLRDDPSQSANLLAEAKKLNDAQAPKVDGSLAEAKEAANAELDSY GVSDFYKRLIDKAKTVEGVEALKDAIL AALP | 116 |
| ABD | LAEAKVLANRELDKYGVSDYYKNLINNAKTVEGVKALIDEILAALP | 117 |
| ABPP107 | AGRERVYLPNLNADQLCAFIRSLEDDPSQSANLLAEAKKLNDAQAPASSSSGSSSSGRASAGGEIVYFPNLNADQLCAFIRSLE DDSSQSANLLAEAKKLNDAQAPK | 118 |
| ABPP108 | AGRERVYLPNLNAHQLCAFIQSLEDDPSQSANLLAEAKKLNDAQAPASSSSGSSSSGRASAGGERVYLPNLNAHQLCAFIRSLE DDPSQSANLLAEAKKLNDAQAPK | 119 |
| ABPP109 | AGGERVYLPNLNAHQLCAFIQSLEDDPSQSANLLAEAKKLNDAQAPASSSSGSSSSGRASAGGERVYLPNLNAHQLCAFIRSLE | 120 |

FIG. 1F

| NAME | SEQUENCE | SEQ ID NO: |
|---|---|---|
| ABPP110 | DDPSQSANLLAEAKKLNDAQAPK | 121 |
| ABPP111 | AGRERVYLPNLNAHQLCAFIRSLEDDPSQSANLLAEAKKLNDAQAPASSSSGSSSSSGRASAGGERVYLPNLNADQLCAFIRSLE<br>DDPSQSANLLAEAKKLNDAQAPK | 122 |
| ABPP112 | AGREVYFPNLNADQLCAFIQSLEDDPSQNANLLAEAKKLNDAQAPASSSSGSSSSSGRASAGGERVYFPNLNADQLCAFIRSLE<br>DDSSQSANLLAEAKKLNDAQAPK | 123 |
| ABPP113 | AGGEMVYLPNLNADQLCAFIRSLEDDPSQSANLLAEAKKLNDAQAPASSSSGSSSSSGRASAGGETVYLPNLNADQLCAFIQSLE<br>DDPSQSANLLAEAKKLNDAQAPK | 124 |
| ABPP114 | AGGERVYLPNLNADQLCAFIRSLEDDPSQSANLLAEAKKLNDAQAPASSSSGSSSSSGRASAGGETVYFPNLNADQLCAFIRSLE<br>DDPSQSANLLAEAKKLNDAQAPK | 125 |
| ABPP115 | AGRERVYLPNLNADQLCAFIQSLEDDSSQSANLLAEAKKLNDAQAPASSSSGSSSSSGRASAGGERVYLPNLNAHQLCAFIRSLE<br>DDPSQSANLLAEAKKLNDAQAPK | 126 |
| ABPP116 | AGRERVYFPNLNADQLCAFIRSLEDDPFSQNANLLAEAKKLNDAQAPASSSSGSSSSSGRASAGGETVYFPNLNADQLCAFINSLE<br>DDPSQSANLLAEAKKLNDAQAPK | 127 |
| ABPP117 | AGRERVYLPNLNAHQLCAFIRSLEDDPSQSANLLAEAKKLNDAQAPASSSSGSSSSSGRASAGGETVYFPNLNADQLCAFIRSLE<br>DDSSQSANLLAEAKKLNDAQAPK | 128 |
| ABPP118 | AGRERVYFPNLNADQLCAFIQSLEDDPSQSANLLAEAKKLNDAQAPASSSSGSSSSSGRASAGGERVYFRNLNAHQLCAFIRSLE<br>DDPSQSANLLAEAKKLNDAQAPK | 129 |
| ABPP119 | AGGEIVYFPNLNADQLCAFIRSLEDDSSQSANLLAEAKKLNDAQAPASSSSGSSSSSGRASAGGERVYFPNLNADQLCAFIRSLE<br>DDPSQSANLLAEAKKLNDAQAPK | 130 |
| ABPP120 | AGRERVYLPNLNADQLCAFIQSLEDDPSQNANLLAEAKKLNDAQAPASSSSGSSSSSGRASAGGERVYFPNLNADQLCAFIRSLE<br>DDPSQSANLLAEAKKLNDAQAPK | 131 |
| ABPP121 | AGRERVYFPNLNAHQLCAFIRSLEDDPSQSANLLAEAKKLNDAQAPASSSSGSSSSSGRASAGGETVYFPNLNADQLCAFIRSLE<br>DDPSQSANLLAEAKKLNDAQAPK | 132 |
| ABPP122 | AGGERVYFPNLNADQLCAFIRSLEDDPSQSANLLAEAKKLNDAQAPASSSSGSSSSSGRASAGGETVYFPNLNAGRERVYLPNLE<br>DDPSQSANLLAEAKKLNDAQAPK | 133 |
| ABPP123 | AGRERVYLPNLNADQLCAFIRSLEDDPSQNANLLAEAKKLNDAQAPASSSSGSSSSSGRASAGGETVVFPNLNADQLCAFIRSLE<br>DDPSQSANLLAEAKKLNDAQAPK | 134 |
| ABPP124 | AGRERVYLPNLNADQLCAFIRSLEDDPFSQNANLLAEAKKLNDAQAPASSSSGSSSSSGRASAGGERVYFPNLNADQLCAFIRSLE<br>DDPSQSANLLAEAKKLNDAQAPK | 135 |
| ABPP125 | AGGERVYLPNLNADQLCAFIRSLEDDPSQNANLLAEAKKLNDAQAPASSSSGSSSSSGRASAGGERVYFPNLNADQLCAFIRSLE<br>DDPSQSANLLAEAKKLNDAQAPK | 136 |
| ABPP126 | AGGERVYLPNLNADQLCAFIQSLEDDPSQSANLLAEAKKLNDAQAPASSSSGSSSSSGRASAGGERVYFPNLNADQLCAFIRSLE<br>DDPSQSANLLAEAKKLNDAQAPK | 137 |
| ABPP127 | AGRERVYFPNLNAHQLCAFIQSLEDDPSQSANLLAEAKKLNDAQAPASSSSGSSSSSGRASAGGERVYLPNLNADQLCAFIRSLE<br>DDPSQSANLLAEAKKLNDAQAPK | 138 |
| ABPP128 | AGRERVYFPNLNADQLCAFIRSLEDDPSQSANLLAEAKKLNDAQAPASSSSGSSSSSGRASAGGETVYFPNLNADQLCAFIRSLE<br>DDPSQSANLLAEAKKLNDAQAPK | 139 |
| ABPP129 | AGGERVYLTNLNADQLCAFIRSLEDDPSQSANLLAEAKKLNDAQAPASSSSGSSSSSGRASAGRERVYLPNLNADQLCAFIRSLE<br>DDPSQQANLLAEAKKLNDAQAPK | 140 |
| ABPP130 | AGGEIVYFPNLNADQLCAFIQSLEDDPSQSANLLAEAKKLNDAQAPASSSSGSSSSSGRASAGRERVYFPNLNADQLCAFIRSLE<br>DDRSQANLLAEAKKLNDAQAPK | 141 |
| ABPP131 | AGRERVYLTNLNADQLCAFIRSLEDDPSQSANLLAEAKKLNDAQAPASSSSGSSSSSGRASAGGERVYFPNLNAHQLCAFIRSIE<br>DDPSQSANLLAEAKKLNDAQAPK | 142 |
| ABPP132 | AGGERVYFPNLNADQLCAFIRSLEDDPSQSANLLAEAKKLNDAQAPASSSSGSSSSSGRASAGGERVYLPNLNADQLCAFIQSLE<br>DDPSQSANLLAEAKKLNDAQAPK | 143 |

FIG. 1G

| NAME | SEQUENCE | SEQ ID NO: |
|---|---|---|
| ABPP133 | AGRERVYLPNLNADQLCAFIRSLEDDPSQSANLLAEAKKLNDAQAPASSSSGSSSSSGRASAGGEIVYITNLNADQLCAFIQSLE DDPSQSANLLAEAKKLNDAQAPK | 144 |
| ABPP134 | AGRERVYLPNLNAHQLCAFIRSLEDDPSQSANLLAEAKKLNDAQAPASSSSGSSSSSGRASAGGEMVYLPNLNADQLCAFIRSLE DDPSQSANLLAEAKKLNDAQAPK | 145 |
| ABPP135 | AGGERVYLPNLNADQLCAFIQSLEDDPSQSANLLAEAKKLNDAQAPASSSSGSSSSSGRASAGGERVYLPNLNAHQLCAFIRSLE DDPSQSANLLAEAKKLNDAQAPK | 146 |
| ABPP136 | AGRERVYLPNLNADQLCAFIRSLEDDPSQSANLLAEAKKLNDAQAPASSSSGSSSSSGRASAGGEIVYFPNLNAHQLCAFIRSLE DDPSQSANLLAEAKKLNDAQAPK | 147 |
| ABPP137 | AGRERVYLPNLNAHQLCAFIRSLEDDPSQSANLLAEAKKLNDAQAPASSSSGSSSSSGRASAGGEIVYFPNLNAHQLCAFIRSLE DDPSQSANLLAEAKKLNDAQAPK | 148 |
| ABPP138 | AGGERVYLPNLNADQLCAFINSLEDDPSQSANLLAEAKKLNDAQAPASSSSGSSSSSGRASAGGEIVYFPNLNADQLCAFIQSLE DDPSQSANLLAEAKKLNDAQAPK | 149 |
| ABPP139 | AGRERVYLPNLNADQLCAFIRSLEDDRSQSANLLAEAKKLNDAQAPASSSSGSSSSSGRASAGGEIVYFPNLNADQLCAFIRSLE DDRSQSANLLAEAKKLNDAQAPK | 150 |
| ABPP140 | AGGERVYLPNLNADQLCAFIQSLEDDPSQNANLLAEAKKLNDAQAPASSSSGSSSSSGRASAGGERVFPNLNAHQLCAFIRSLE DDSSQSANLLAEAKKLNDAQAPK | 151 |
| ABPP141 | AGGERVYFPNLNADQLCAFIRSLEDDPSQSANLLAEAKKLNDAQAPASSSSGSSSSSGRASAGGEIVYFPNLNADQLCAFIRSLE DDSSQSANLLAEAKKLNDAQJQPK | 152 |
| ABPP142 | AGRERVYLPNLNADQLCAFIRSLEDDPSQSANLLAEAKKLNDAQAPASSSSGSSSSSGRASAGGEIVYLPNLNAHQLCAFIQSLE DDPSQSANLLAEAKKLNDAQAPK | 153 |
| ABPP143 | AGGERVYLRNLNAHQLCAFIRSLEDDPSQSANLLAEAKKLNDAQAPASSSSGSSSSSGRASAGRERVYLPNLNADQLCAFIRSLE DDPSQQANLLAEAKKLNDAQAPK | 154 |
| ABPP144 | AGRERVYLPNLNAHQLCAFIRSLEDDPSQSANLLAEAKKLNDAQAPASSSSGSSSSSGRASAGRERVYLPNLNADQLCAFIRSLE DDPSQSANLLAEAKKLNDAQAPK | 155 |
| ABPP145 | AGGERVYLPNLNADQLCAFIQSLEDDPSQQANLLAEAKKLNDAQAPASSSSGSSSSSGRASAGERVYLPNLNADQLCAFIRSLE DDRSQSANLLAEAKKLNDAQAPK | 156 |
| ABPP146 | AGRERVYFPNLNADQLCAFIRSLEDDPSQQANLLAEAKKLNDAQAPASSSSGSSSSSGRASAGRERVYLPNLNADQLCAFIRSLE DDPSQSANLLAEAKKLNDAQAPK | 157 |
| ABPP147 | AGRERVYLPNLNAHQLCAFIRSLEDDPSQQANLLAEAKKLNDAQAPASSSSGSSSSSGRASAGRERVYLPNLNADQLCAFINSLE DDRSQQANLLAEAKKLNDAQAPK | 158 |
| ABPP148 | AGGERVYLPNLNADQLCAFIRSLEDDPSQSANLLAEAKKLNDAQAPASSSSGSSSSSGRASAGGEIVYFPNLNAHQLCAFINSLE DDPSQSANLLAEAKKLNDAQAPK | 159 |
| ABPP149 | AGRERVYLPNLNADQLCAFIRSLEDDSSQSANLLAEAKKLNDAQAPASSSSGSSSSSGRASAGGEIVYFPNLNAHQLCAFIRSLE DDESQSANLLAEAKKLNDAQAPK | 160 |
| ABPP150 | AGRERVYLPNLNADQLCAFIRSLEDDPSQSANLLAEAKKLNDAQAPASSSSGSSSSSGRASAGGEIVYLPNLNADQLCAFIRSLE DDPSQSANLLAEAKKLNDAQAPK | 161 |
| ABPP151 | AGRERVYFPNLNADQLCAFIRSLEDDPSQSANLLAEAKKLNDAQAPASSSSGSSSSSGRASAGGEMVYLPNLNADQLCAFIRSLE DDPSQSANLLAEAKKLNDAQAPK | 162 |
| ABPP152 | AGGERVYLPNLNADQLCAFIRSLEDDPSQSANLLAEAKKLNDAQAPASSSSGSSSSSGRASAGGEIVYLPNLNADQLCAFIRSLE DDPSQSANLLAEAKKLNDAQAPK | 163 |
| ABPP153 | AGGETVYLPNLNADQLCAFIRSLEDDPSQSANLLAEAKKLNDAQAPASSSSGSSSSSGRASAGGEIVYFPNLNAHQLCAFIRSLE DDPSQSANLLAEAKKLNDAQAPK | 164 |
| ABPP154 | AGGERVYLPNLNADQLCAFIRSLEDDSSQSNANLLAEAKKLNDAQAPASSSSGSSSSSGRASAGGEIVYFPNLNADQLCAFIRSLE DDSSQSANLLAEAKKLNDAQAPK | 165 |
| ABPP155 | AGGERVYLPNLNADQLCAFIRSLEDDSSQSANLLAEAKKLNDAQAPASSSSGSSSSSGRASAGGERVYLPNLNADQLCAFIRSLE DDPSQSANLLAEAKKLNDAQAPK | 166 |
| ABPP156 | AGGETVYLPNLNADQLCAFIRSLEDDPSQSANLLAEAKKLNDAQAPASSSSGSSSSSGRASAGGEIVYLPNLNAHQLCAFIQSLE DDPSQSANLLAEAKKLNDAQAPK | 167 |

FIG. 1H

| NAME | SEQUENCE | SEQ ID NO: |
|---|---|---|
| ABPP157 | AGGEQVYLPNLNADQLCAFIRSLEDDPSQSANLLAEAKKLNDAQAPASSSSGSSSSGRASAGGEMVYLPNLNAHQLCAFIRSLE DDPSQSANLLAEAKKLNDAQAPK | 168 |
| ABPP158 | AGGEQVYLPNLNADQLCAFIQSLEDDPSQSANLLAEAKKLNDAQAPASSSSGSSSSGRASAGGEIVYLPNLNADQLCAFIQSLE DDPSQSANLLAEAKKLNDAQAPK | 169 |
| ABPP159 | AGGEQVYLPNLNAHQLCAFIRSLEDDPSQSANLLAEAKKLNDAQAPASSSSGSSSSGRASAGGEMVYLPNLNAHQLCAFIRSLE DDPSQSANLLAEAKKLNDAQAPK | 170 |
| ABPP160 | AGGERVYLPNLNADQLCAFIRSLEDDPSQRANLLAEAKKLNDAQAPASSSSGSSSSGRASAGGERVYLPNLNADQLCAFIRSLE DDPSQSANLLAEAKKLNDAQAPK | 171 |
| ABPP161 | AGGEMVYLPNLNADQLCAFIQSLEDDPSQSANLLAEAKKLNDAQAPASSSSGSSSSGRASAGGETVYLPNLNAHQLCAFIRSLE DDPSQSANLLAEAKKLNDAQAPK | 172 |
| ABPP162 | AGGERVYLPNLNADQLCAFIRSLEDDPSQNANLLAEAKKLNDAQAPASSSSGSSSSGRASAGGERVYLPNLNADQLCAFIRSLE DDPSQSANLLAEAKKLNDAQAPK | 173 |
| ABPP163 | AGGEMVYFPNLNADQLCAFIRSLEDDPSQSANLLAEAKKLNDAQAPASSSSGSSSSGRASAGGEIVYLPNLNADQLCAFIQSLE DDPSQSANLLAEAKKLNDAQAPK | 174 |
| ABPP164 | AGGERVYLPNLNADQLCAFIRSLEDDPSQSANLLAEAKKLNDAQAPASSSSGSSSSGRASAGGEIVYLPNLNADQLCAFIQSLE DDPSQSANLLAEAKKLNDAQAPK | 175 |
| ABPP165 | AGGERVYLRNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 176 |
| ABPP166 | AGGERVYLPNLNADQLCAFIQSLEDDSSQNANLLAEAKKLNDAQAPASSSSGSSSSGRASAGGEIVYLPNLNAHQLCAFIRSLE DDSSQNANLLAEAKKLNDAQAPK | 177 |
| ABPP167 | AGGETVYLPNLNADQLCAFIRSLEDDPSQSANLLAEAKKLNDAQAPASSSSGSSSSGRASAGGETVYLPNLNADQLCAFIQSLE DDPSQSANLLAEAKKLNDAQAPK | 178 |
| ABPP168 | AGGETVYLPNLNADQLCAFIRSLEDDRSQSANLLAEAKKLNDAQAPASSSSGSSSSGRASAGGEIVYLPNLNAHQLCAFIRSLE DDPSQSANLLAEAKKLNDAQAPK | 179 |
| ABPP169 | AGGEQVYLPNLNADQLCAFIQSLEDDPSQSANLLAEAKKLNDAQAPASSSSGSSSSGRASAGGERVYLPNLNADQLCAFIQSLE DDPSQSANLLAEAKKLNDAQAPK | 180 |
| ABPP170 | AGGEIVYLPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 181 |
| ABPP171 | AGGERVYLPNLNADQLCAFIRSLEDDPSQSANLLAEAKKLNDAQAPASSSSGSSSSGRASAGGEIVYFPNLNAHQLCAFIRSLE DDPSQSANLLAEAKKLNDAQAPK | 182 |
| ABPP172 | AGGERVYLPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 183 |
| ABPP173 | AGGEMVYFPNLNADQLCAFIRSLEDDPSQSANLLAEAKKLNDAQAPASSSSGSSSSGRASAGGERVYLPNLNAHQLCAFIRSLE DDPSQSANLLAEAKKLNDAQAPK | 184 |
| ABPP174 | AGGEIVYLPNLNADQLCAFIRSLEDDPSQSANLLAEAKKLNDAQAPASSSSGSSSSGRASAGGERVYLPNLNADQLCAFIQSLE DDPSQSANLLAEAKKLNDAQAPK | 185 |
| ABPP175 | AGGEMVYLPNLNADQLCAFIRSLEDDPSQSANLLAEAKKLNDAQAPASSSSGSSSSGRASAGGETVYLPNLNAHQLCAFIRSLE DDPSQSANLLAEAKKLNDAQAPK | 186 |
| ABPP176 | AGGEQVYLPNLNAHQLCAFIRSLEDDPSQQANLLAEAKKLNDAQAPASSSSGSSSSGRASAGGEIVYLPNLNAHQLCAFIRSLE DDPSQSANLLAEAKKLNDAQAPK | 187 |
| ABPP177 | AGGERVYLPNLNADQLCAFIRSLEDDSSQSANLLAEAKKLNDAQAPASSSSGSSSSGRASAGGEMVYLPNLNADQLCAFIRSLE DDPSQSANLLAEAKKLNDAQAPK | 188 |
| ABPP178 | AGGERVYLPNLNAHQLCAFIRSLEDDPSQSANLLAEAKKLNDAQAPASSSSGSSSSGRASAGGEIVYLPNLNADQLCAFIRSLE DDPSQSANLLAEAKKLNDAQAPK | 189 |
| ABPP179 | AGGETVYLPNLNADQLCAFIRSLEDDPSQQANLLAEAKKLNDAQAPASSSSGSSSSGRASAGGERVYLPNLNADQLCAFIRSLE DDPSQRANLLAEAKKLNDAQAPK | 190 |
| ABPP180 | AGGEMVYLPNLNADQLCAFIQSLEDDPSQSANLLAEAKKLNDAQAPASSSSGSSSSGRASAGGEIVYFPNLNADQLCAFIQSLE DDPSQSANLLAEAKKLNDAQAPK | 191 |

FIG. 1I

| NAME | SEQUENCE | SEQ ID NO: |
|---|---|---|
| ABPP181 | AGGETVYLPNLNAHQLCAFIQSLEDDPSQSANLLAEAKKLNDAQAPASSSSGSSSSGRASAGRERVYLPNLNADQLCAFIRSLE DDPSQSANLLAEAKKLNDAQAPK | 192 |
| ABPP182 | AGGEYVYLPNLNADQLCAFIRSLEDDPSQSANLLAEAKKLNDAQAPASSSSGSSSSGRASAGGEIVYFPNLNADQLCAFIQSLE DDPSQSANLLAEAKKLNDAQAPK | 193 |
| ABPP183 | AGGERVYLPNLNAHQLCAFIRSLEDDPSQSANLLAEAKKLNDAQAPASSSSGSSSSGRASAGGEIVYLPNLNADQLCAFIRSLE DDPSQSANLLAEAKKLNDAQAPK | 194 |
| ABPP184 | AGGETVYLPNLNADQLCAFIRSLEDDPSQNANLLAEAKKLNDAQAPASSSSGSSSSGRASAGGEIVYFPNLNADQLCAFIRSLE DDPSQSANLLAEAKKLNDAQAPK | 195 |
| ABPP185 | AGGETVYLPNLNAHQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 196 |
| ABPP186 | AGGERVYLPNLNADQLCAFIRSLEDDPSQSANLLAEAKKLNDAQAPASSSSGSSSSGRASAGGEQVYLPNLPNLNADQLCAFIQSLE DDPSQSANLLAEAKKLNDAQAPK | 197 |
| ABPP187 | AGGETVYLPNLNADQLCAFIRSLEDDPSQSANLLAEAKKLNDAQAPASSSSGSSSSGRASAGGEMVYLPNLNADQLCAFIQSLE DDPSQSANLLAEAKKLNDAQAPK | 198 |
| ABPP188 | AGGERVYLPNLNADQLCAFIRSLEDDPSQSANLLAEAKKLNDAQAPASSSSGSSSSGRASAGGEIVYLPNLNADQLCAFIRSLE DDPSQSANLLAEAKKLNDAQAPK | 199 |
| ABPP189 | AGGETVYLRNLNADQLCAFIRSLEDDPSQSANLLAEAKKLNDAQAPASSSSGSSSSGRASAGGEIVYLPNLNAHQLCAFIRSLE DDRSQSANLLAEAKKLNDAQAPK | 200 |
| ABPP190 | AGGETVYLPNLNADQLCAFIRSLEDDPSQSANLLAEAKKLNDAQAPASSSSGSSSSGRASAGGEIVYLPNLNADQLCAFIRSLE DDSSQNANLLAEAKKLNDAQAPK | 201 |
| ABPP191 | AGGETVYLPNLNADQLCAFINSLEDDPSQSANLLAEAKKLNDAQAPASSSSGSSSSGRASAGGEIVYLPNLNAHQLCAFIRSLE DDPSQSANLLAEAKKLNDAQAPK | 202 |
| ABPP192 | AGGETVYLPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 203 |
| ABPP193 | AGGERVYLPNLNADQLCAFIRSLEDDPSQSANLLAEAKKLNDAQAPASSSSGSSSSGRASAGGEIVYFPNLNADQLCAFIRSLE DDPSQSANLLAEAKKLNDAQAPK | 204 |
| ABPP194 | AGGETVYFPNLNADQLCAFIRSLEDDRSQSANLLAEAKKLNDAQAPASSSSGSSSSGRASAGGEIVYLPNLNAHQLCAFIRSLE DDRSQSANLLAEAKKLNDAQAPK | 205 |
| ABPP195 | AGGERVYLPNLNADQLCAFIRSLEDDPSQSANLLAEAKKLNDAQAPASSSSGSSSSGRASAGGEMVYLPNLNADQLCAFIRSLE DDPSQSANLLAEAKKLNDAQAPK | 206 |
| ABPP196 | AGGETVYLPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 207 |
| ABPP197 | AGGERVYLPNLNAHQLCAFIRSLEDDPSQSANLLAEAKKLNDAQAPASSSSGSSSSGRASAGGERVYLPNLNADQLCAFIRSLE DDPSQSANLLAEAKKLNDAQAPK | 208 |
| ABPP198 | AGGERVYLPNLNADQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 209 |
| ABPP199 | AGGERVYLPNLNADQLCAFIQSLEDDPSQSANLLAEAKKLNDAQAPASSSSGSSSSGRASAGGERVYLPNLNADQLCAFIRSLE DDSSQSANLLAEAKKLNDAQAPK | 210 |
| ABPP200 | AGGEQVYLPNLNADQLCAFIRSLEDDPSQSANLLAEAKKLNDAQAPASSSSGSSSSGRASAGGEIVYFPNLNAHQLCAFIRSLE DDSSQNANLLAEAKKLNDAQAPK | 211 |
| ABPP201 | AGGEIVYLPNLNADQLCAFIQSLEDDPSQSANLLAEAKKLNDAQAPASSSSGSSSSGRASAGGEIVYFPNLNADQLCAFIRSLE DDPSQSANLLAEAKKLNDAQAPK | 212 |
| ABPP202 | AGGEMVYLPNLNADQLCAFIRSLEDDRSQNANLLAEAKKLNDAQAPASSSSGSSSSGRASAGGEIVYFPNLNAHQLCAFIRSLE DDSSQNANLLAEAKKLNDAQAPK | 213 |
| ABPP203 | AGGEIVYLPNLNADQLCAFIRSLEDDRSQSANLLAEAKKLNDAQAPASSSSGSSSSGRASAGGEIVYFPNLNAHQLCAFIRSLE DDSSQSANLLAEAKKLNDAQAPK | 214 |
| ABPP204 | AGGEIVYLPNLNADQLCAFIQSLEDDSSQSANLLAEAKKLNDAQAPASSSSGSSSSGRASAGGEQVYLPNLNADQLCAFIRSLE DDPSQSANLLAEAKKLNDAQAPK | 215 |

FIG. 1J

| NAME | SEQUENCE | SEQ ID NO: |
|---|---|---|
| ABPP205 | AGGEMVYLPNLNAHQLCAFIRSLEDDPSQSANLLAEAKKLNDAQAPASSSSGSSSSGRASAGGEIVYLPNLNADQLCAFIRSLE DDPSQSANLLAEAKKLNDAQAPK | 216 |
| ABPP206 | AGGEIVYLPNLNADQLCAFIRSLEDDPSQSANLLAEAKKLNDAQAPASSSSGSSSSGRASAGGEMVYFPNLNAHQLCAFIRSLE DDPSQSANLLAEAKKLNDAQAPK | 217 |
| ABPP207 | AGGERVYFPNLNAHQLCAFIRSLEDDPSQSANLLAEAKKLNDAQAPASSSSGSSSSGRASAGGEIVYLPNLNADQLCAFIQSLE DDPSQSANLLAEAKKLNDAQAPK | 218 |
| ABPP208 | AGGEIVYFPNLNADQLCAFIQSLEDDPSQSANLLAEAKKLNDAQAPASSSSGSSSSGRASAGGEIVYFPNLNAHQLCAFIRSLE DDPSQSANLLAEAKKLNDAQAPK | 219 |
| ABPP209 | AGGERVYLPNLNAHQLCAFIRSLEDDPSQNANLLAEAKKLNDAQAPASSSSGSSSSGRASAGGEIVYLPNLNADQLCAFIRSLE DDQSQNANLLAEAKKLNDAQAPK | 220 |
| ABPP210 | AGGEIVYLPNLNADQLCAFIRSLEDDPSQSANLLAEAKKLNDAQAPASSSSGSSSSGRASAGGEMVYLPNLNAHQLCAFIRSLE DDPSQSANLLAEAKKLNDAQAPK | 221 |
| ABPP211 | AGGEQVYLPNLNAHQLCAFIRSLEDDPSQSANLLAEAKKLNDAQAPASSSSGSSSSGRASAGREQVYLPNLNADQLCAFIQSLE DDPSQSANLLAEAKKLNDAQAPK | 222 |
| ABPP212 | AGGEIVYFPNLNADQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 223 |
| ABPP213 | AGGEIVYFPNLNADQLCAFIQSLEDDPSQQANLLAEAKKLNDAQAPASSSSGSSSSGRASAGGEIVYLPNLNADQLCAFIQSLE DDPSQSANLLAEAKKLNDAQAPK | 224 |
| ABPP214 | AGRERVYLPNLNADQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 225 |
| ABPP215 | AGGERVYLPNLNADQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 226 |
| ABPP216 | AGGEQVYLPNLNADQLCAFIRSLEDDPSQSANLLAEAKKLNDAQAPASSSSGSSSSGRASAGRERVYLPNLNADQLCAFIRSLE DDPSQSANLLAEAKKLNDAQAPK | 227 |
| ABPP217 | AGGERVYLPNLNAHQLCAFIRSLEDDPSQSANLLAEAKKLNDAQAPASSSSGSSSSGRASAGGEIVYFPNLNADQLCAFIQSLE DDPSQSANLLAEAKKLNDAQAPK | 228 |
| ABPP218 | AGGEIVYFPNLNAHQLCAFIRSLEDDESQSANLLAEAKKLNDAQAPASSSSGSSSSGRASAGGEIVYFPNLNAHQLCAFIRSLE DDPSQSANLLAEAKKLNDAQAPK | 229 |
| ABPP219 | AGGERVYFPNLNADQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 230 |
| ABPP220 | AGGEIVYFPNLNADQLCAFIRSLEDDPSQSANLLAEAKKLNDAQAPASSSSGSSSSGRASAGGEIVYFPNLNAHQLCAFIRSLE DDPSQSANLLAEAKKLNDAQAPK | 231 |
| ABPP221 | AGGERVYLPNLNADQLCAFIQSLEDDPSQSANLLAEAKKLNDAQAPASSSSGSSSSGRASAGGEIVYFPNLNAHQLCAFIRSLE DDPSQSANLLAEAKKLNDAQAPK | 232 |
| ABPP222 | AGGERVYLPNLNADQLCAFIRSLEDDSSQSANLLAEAKKLNDAQAPASSSSGSSSSGRASAGGEIVYLPNLNAHQLCAFIRSLE DDPSQSANLLAEAKKLNDAQAPK | 233 |
| ABPP223 | AGGERVYLPNLNADQLCAFIRSLEDDPSQSANLLAEAKKLNDAQAPASSSSGSSSSGRASAGGERVYLPNLNAHQLCAFIRSLE DDPSQSANLLAEAKKLNDAQAPK | 234 |
| ABPP224 | AGGERVYLPNLNADQLCAFIRSLEDDPSQNANLLAEAKKLNDAQAPASSSSGSSSSGRASAGGERVYLPNLNAHQLCAFIRSLE DDRSQSANLLAEAKKLNDAQAPK | 235 |
| ABPP225 | AGGEIVYLPNLNADQLCAFIQSLEDDPSQSANLLAEAKKLNDAQAPASSSSGSSSSGRASAGGERVYLPNLNAHQLCAFIRSLE DDPSQSANLLAEAKKLNDAQAPK | 236 |
| ABPP226 | AGRERVYLRNLNADQLCAFIRSLEDDPSQNANLLAEAKKLNDAQAPASSSSGSSSSGRASAGRERVYLPNLNAHQLCAFIRSLE DDRSQSANLLAEAKKLNDAQAPK | 237 |
| ABPP227 | AGGEIVYFPNLNADQLCAFIRSLEDDPSQSANLLAEAKKLNDAQAPASSSSGSSSSGRASAGRERVYLPNLNAHQLCAFIRSLE DDPSQSANLLAEAKKLNDAQAPK | 238 |
| ABPP228 | AGGERVYLPNLNADQLCAFIRSLEDDPSQSANLLAEAKKLNDAQAPASSSSGSSSSGRASAGGEIVYFPNLNADQLCAFINSLE DDPSQSANLLAEAKKLNDAQAPK | 239 |

FIG. 1K

| NAME | SEQUENCE | SEQ ID NO: |
|---|---|---|
| ABPP229 | AGGETVYLPNLNAHQLCAFIRSLEDDPSQSANLLAEAKKLNDAQAPASSSSGSSSSGRASAGGETVYFPNLNADQLCAFIRSLE DDPSQSANLLAEAKKLNDAQAPK | 240 |
| ABPP230 | AGGERVYLTNLNAHQLCAFIRSLEDDPSQQANLLAEAKKLNDAQAPASSSSGSSSSGRASAGGETVYLPNLNADQLCAFIQSLE DDPSQRANLLAEAKKLNDAQAPK | 241 |
| ABPP231 | AGGERVYLPNLNADQLCAFIQSLEDDPSQSANLLAEAKKLNDAQAPASSSSGSSSSGRASAGGETVYLPNLNADQLCAFIRSLE DDPSQNANLLAEAKKLNDAQAPK | 242 |
| ABPP232 | AGGETVYLPNLNAHQLCAFIRSLEDDQSQNANLLAEAKKLNDAQAPASSSSGSSSSGRASAGGEIVYFPNLNADQLCAFIRSLE DDPSQSANLLAEAKKLNDAQAPK | 243 |
| ABPP233 | AGGETVYFPNLNAHQLCAFIRSLEDDESQNANLLAEAKKLNDAQAPASSSSGSSSSGRASAGREQVYLPNLNADQLCAFIRSLE DDPSQSANLLAEAKKLNDAQAPK | 244 |
| ABPP234 | AGGETVYLPNLNAHQLCAFIRSLEDDRSQSANLLAEAKKLNDAQAPASSSSGSSSSGRASAGGETVYLPNLNADQLCAFIQSLE DDPSQSANLLAEAKKLNDAQAPK | 245 |
| ABPP235 | AGGERVYLPNLNAHQLCAFIRSLEDDPSQSANLLAEAKKLNDAQAPASSSSGSSSSGRASAGGETVYLPNLNADQLCAFIQSLE DDPSQNANLLAEAKKLNDAQAPK | 246 |
| ABPP236 | AGGETVYLPNLNADQLCAFIQSLEDDPSQSANLLAEAKKLNDAQAPASSSSGSSSSGRASAGGEIVYLPNLNADQLCAFIRSLE DDPSQCANLLAEAKKLNDAQAPK | 247 |
| ABPP237 | AGGETVYLPNLNAHQLCAFIRSLEDDPSQSANLLAEAKKLNDAQAPASSSSGSSSSGRASAGGEIVYLPNLNAHQLCAFIRSLE DDPSQCANLLAEAKKLNDAQAPK | 248 |
| ABPP238 | AGGEMVYLPNLNAHQLCAFIRSLEDDPSQNANLLAEAKKLNDAQAPASSSSGSSSSGRASAGGETVYFPNLNAHQLCAFIRSLE DDPSQSANLLAEAKKLNDAQAPK | 249 |
| ABPP239 | AGGETVYLPNLNADQLCAFIQSLEDDPSQQANLLAEAKKLNDAQAPASSSSGSSSSGRASAGGEIVYFPNLNADQLCAFIRSLE DDPSQSANLLAEAKKLNDAQAPK | 250 |
| ABPP240 | AGRERVYLPNLNADQLCAFIQSLEDDPSQSANLLAEAKKLNDAQAPASSSSGSSSSGRASAGGEIVYLPNLNADQLCAFIRSLE DDPSQSANLLAEAKKLNDAQAPK | 251 |
| ABPP241 | AGGETVYLPNLNAHQLCAFIRSLEDDPSQNANLLAEAKKLNDAQAPASSSSGSSSSGRASAGGETVYLPNLNADQLCAFIQSLE DDPSQSANLLAEAKKLNDAQAPK | 252 |
| ABPP242 | AGGETVYLPNLNADQLCAFIQSLEDDPSQSANLLAEAKKLNDAQAPASSSSGSSSSGRASAGRERVYLPNLNADQLCAFIRSLE DDPSQSANLLAEAKKLNDAQAPK | 253 |
| ABPP243 | AGGETVYFPNLNADQLCAFIQSLEDDPSQSANLLAEAKKLNDAQAPASSSSGSSSSGRASAGRERVYLPNLNADQLCAFIRSLE DDQSQSANLLAEAKKLNDAQAPK | 254 |
| ABPP244 | AGGETVYLPNLNADQLCAFIQSLEDDPSQSANLLAEAKKLNDAQAPASSSSGSSSSGRASAGGEIVYLPNLNADQLCAFIRSLE DDQSQSANLLAEAKKLNDAQAPK | 255 |
| ABPP245 | AGGETVYLPNLNADQLCAFIQSLEDDPSQSANLLAEAKKLNDAQAPASSSSGSSSSGRASAGGEMVYFPNLNADQLCAFIRSLE DDPSQSANLLAEAKKLNDAQAPK | 256 |
| ABPP246 | AGGERVYLPNLNAHQLCAFIRSLEDDPSQSANLLAEAKKLNDAQAPASSSSGSSSSGRASAGGEIVYLPNLNADQLCAFIQSLE DDRSQSANLLAEAKKLNDAQAPK | 257 |
| ABPP247 | AGGETVYFPNLNAHQLCAFIRSLEDDPSQNANLLAEAKKLNDAQAPASSSSGSSSSGRASAGGEIVYFPNLNADQLCAFIRSLE DDSSQNANLLAEAKKLNDAQAPK | 258 |
| ABPP248 | AGGETVYFPNLNADQLCAFIQSLEDDPSQSANLLAEAKKLNDAQAPASSSSGSSSSGRASAGGEIVYFPNLNADQLCAFIRSLE DDPSQSANLLAEAKKLNDAQAPK | 259 |
| ABPP249 | AGGETVYLPRNLNAHQLCAFIRSLEDDPSQSANLLAEAKKLNDAQAPASSSSGSSSSGRASAGGEMVYLPNLNADQLCAFIQSLE DDPSQSANLLAEAKKLNDAQAPK | 260 |
| ABPP250 | AGGETVYFPNLNAHQLCAFIRSLEDDPSQSANLLAEAKKLNDAQAPASSSSGSSSSGRASAGRERVYLPNLNADQLCAFIRSLE DDPSQCANLLAEAKKLNDAQAPK | 261 |
| ABPP251 | AGGETVYFPNLNAHQLCAFIRSLEDDPSQSANLLAEAKKLNDAQAPASSSSGSSSSGRASAGGEIVYLPNLNADQLCAFIRSLE DDPSQSANLLAEAKKLNDAQAPK | 262 |
| ABPP252 | AGGERVYLPNLNADQLCAFIRSLEDDSSQSANLLAEAKKLNDAQAPASSSSGSSSSGRASAGGEIVYLPNLNADQLCAFIRSLE DDPSQSQSANLLAEAKKLNDAQAPK | 263 |

FIG. 1L

| NAME | SEQUENCE | SEQ ID NO: |
|---|---|---|
| ABPP253 | AGRERVYLPNLNADQLCAFIQSLEDDPSQSANLLAEAKKLNDAQAPASSSSGSSSSGRASAGGEIVYFPNLNADQLCAFIQSLE<br>DDPSQSANLLAEAKKLNDAQAPK | 264 |
| ABPP254 | AGGEIVYFPNLNAHQLCAFIQSLEDDPSQNANLLAEAKKLNDAQAPASSSSGSSSSGRASAGGEIVYFPNLNADQLCAFIRSLE<br>DDPSQSANLLAEAKKLNDAQAPK | 265 |
| ABPP255 | AGGEIVYLPNLNADQLCAFIQSLEDDPSQSANLLAEAKKLNDAQAPASSSSGSSSSGRASAGGEIVYLPNLNADQLCAFIRSLE<br>DDPSQSANLLAEAKKLNDAQAPK | 266 |
| ABPP256 | AGERVYLRPNLNAHQLCAFIRSLEDDPSQSANLLAEAKKLNDAQAPASSSSGSSSSGRASAGGEIVYLPNLNADQLCAFIRSLE<br>DDPSQSANLLAEAKKLNDAQAPK | 267 |
| ABPP257 | AGGEMVYLPNLNADQLCAFIRSLEDDPSQSANLLAEAKKLNDAQAPASSSSGSSSSGRASAGRERVYLPNLNADQLCAFIRSLE<br>DDPSQSANLLAEAKKLNDAQAPK | 268 |
| ABPP258 | AGRERVYLPNLNAHQLCAFIQSLEDDPSQSANLLAEAKKLNDAQAPASSSSGSSSSGRASAGGEIVYLPNLNADQLCAFIRSLE<br>DDPSQSANLLAEAKKLNDAQAPK | 269 |
| ABPP259 | AGGEIVYFPNLNADQLCAFIQSLEDDPSQSANLLAEAKKLNDAQAPASSSSGSSSSGRASAGGEIVYLPNLNADQLCAFINSLE<br>DDPSQSANLLAEAKKLNDAQAPK | 270 |
| ABPP260 | AGGEIVYLPNLNADQLCAFIRSLEDDPSQSANLLAEAKKLNDAQAPASSSSGSSSSGRASAGGEIVYLPNLNAHQLCAFIRSLE<br>DDPSQSANLLAEAKKLNDAQAPK | 271 |
| ABPP261 | AGGEIVYLPNLNADQLCAFIRSLEDDPSQSANLLAEAKKLNDAQAPASSSSGSSSSGRASAGGEIVYLPNLNADQLCAFIQSLE<br>DDRSQSANLLAEAKKLNDAQAPK | 272 |
| ABPP262 | AGEIVYLPNLNAHQLCAFIRSLEDDPSQSANLLAEAKKLNDAQAPASSSSGSSSSGRASAGGEIVYLPNLNADQLCAFIRSLE<br>DDPSQSANLLAEAKKLNDAQAPK | 273 |
| ABPP263 | AGGEIVYFPNLNAHQLCAFIRSLEDDPSQSANLLAEAKKLNDAQAPASSSSGSSSSGRASAGRERVYFPNLNADQLCAFIRSLE<br>DDPSQSANLLAEAKKLNDAQAPK | 274 |
| ABPP264 | AGREQVYFPNLNADQLCAFIRSLEDDPSQSANLLAEAKKLNDAQAPASSSSGSSSSGRASAGGEIVYLPNLNAHQLCAFIRSLE<br>DDPSQSANLLAEAKKLNDAQAPK | 275 |
| ABPP265 | AGRERVYLPNLNADQLCAFIQSLEDDPSQSANLLAEAKKLNDAQAPASSSSGSSSSGRASAGGERVYFPNLNAHQLCAFIQSLE<br>DDPSQSANLLAEAKKLNDAQAPK | 276 |
| ABPP266 | AGGEIVYLPNLNADQLCAFIRSLEDDPSQSANLLAEAKKLNDAQAPASSSSGSSSSGRASAGGEMVYLPNLNADQLCAFIQSLE<br>DDPSQSANLLAEAKKLNDAQAPK | 277 |
| ABPP267 | AGRERVYLPNLNAHQLCAFIRSLEDDPSQSANLLAEAKKLNDAQAPASSSSGSSSSGRASAGGEIVYLPNLNADQLCAFIRSLE<br>DDPSQSANLLAEAKKLNDAQAPK | 278 |
| ABPP268 | AGREVVYFPNLNAHQLCAFIRSLEDDPSQNANLLAEAKKLNDAQAPASSSSGSSSSGRASAGGEMVYFPNLNADQLCAFINSLE<br>DDPSQSANLLAEAKKLNDAQAPK | 279 |
| ABPP269 | AGEIVYLPNLNAHQLCAFIQSLEDDPSQSANLLAEAKKLNDAQAPASSSSGSSSSGRASAGGEIVYFPNLNADQLCAFIQSLE<br>DDPSQSANLLAEAKKLNDAQAPK | 280 |
| ABPP270 | AGGEIVYLPNLNAHQLCAFINSLEDDPSQNANLLAEAKKLNDAQAPASSSSGSSSSGRASAGGEIVYLPNLNADQLCAFIQSLE<br>DDPSQSANLLAEAKKLNDAQAPK | 281 |
| ABPP271 | AGGEIVYLPNLNADQLCAFIRSLEDDRSQSANLLAEAKKLNDAQAPASSSSGSSSSGRASAGGEIVYLPNLNADQLCAFIQSLE<br>DDPSQSANLLAEAKKLNDAQAPK | 282 |
| ABPP272 | AGERVYFPNLNADQLCAFIRSLEDDPSQSANLLAEAKKLNDAQAPASSSSGSSSSGRASAGGEIVYLPNLNADQLCAFIRSLE<br>DDPSQSANLLAEAKKLNDAQAPK | 283 |
| ABPP273 | AGGEIVYFPNLNADQLCAFIRSLEDDPSQSANLLAEAKKLNDAQAPASSSSGSSSSGRASAGGEMVYLPNLNADQLCAFIRSLE<br>DDPSQSANLLAEAKKLNDAQAPK | 284 |
| ABPP274 | AGGEMVYLPNLNADQLCAFIRSLEDDSSQSANLLAEAKKLNDAQAPASSSSGSSSSGRASAGGEMVYLPNLNADQLCAFIRSLE<br>DDPSQSANLLAEAKKLNDAQAPK | 285 |
| ABPP275 | AGGEIVYLPNLNADQLCAFIQSLEDDPSQSANLLAEAKKLNDAQAPASSSSGSSSSGRASAGGEIVYLPNLNAHQLCAFIRSLE<br>DDPSQSANLLAEAKKLNDAQAPK | 286 |
| ABPP276 | AGGEIVYLPNLNADQLCAFIQSLEDDPSQNANLLAEAKKLNDAQAPASSSSGSSSSGRASAGGEIVYFPNLNADQLCAFIRSLE<br>DDPSQSANLLAEAKKLNDAQAPK | 287 |

FIG. 1M

| NAME | SEQUENCE | SEQ ID NO: |
|---|---|---|
| ABPP277 | AGGERVYLPNLNADQLCAFIRSLEDDPSQSANLLAEAKKLNDAQAPASSSSGSSSSGRASAGGETVVYITNLNADQLCAFIRSLE DDPSQSANLLAEAKKLNDAQAPK | 288 |
| ABPP278 | AGGETVYLPNLNADQLCAFINSLEDDPSQSANLLAEAKKLNDAQAPASSSSGSSSSGRASAGGETVVYFPNLNAHQLCAFIRSLE DDPSQSANLLAEAKKLNDAQAPK | 289 |
| ABPP279 | AGGETVYLPNLNADQLCAFIQSLEDDPSQSANLLAEAKKLNDAQAPASSSSGSSSSGRASAGGERVYLPNLNAHQLCAFIQSLE DDPSQSANLLAEAKKLNDAQAPK | 290 |
| ABPP280 | AGGERVYLPNLNADQLCAFIRSLEDDPSQSANLLAEAKKLNDAQAPASSSSGSSSSGRASAGGEIVYFPNLNADQLCAFINSLE DDPSQSANLLAEAKKLNDAQAPK | 291 |
| ABPP281 | AGGEQVYLPNLNADQLCAFIQSLEDDPSQQANLLAEAKKLNDAQAPASSSSGSSSSGRASAGGETVYFPNLNADQLCAFIRSLE DDPSSQANLLAEAKKLNDAQAPK | 292 |
| ABPP282 | AGGERVYLPNLNADQLCAFIRSLEDDPSQSANLLAEAKKLNDAQAPASSSSGSSSSGRASAGRERVYLPNLNAHQLCAFIRSLE DDPSQSANLLAEAKKLNDAQAPK | 293 |
| ABPP283 | AGGERVYLPNLNADQLCAFIRSLEDDSSQSANLLAEAKKLNDAQAPASSSSGSSSSGRASAGRERVYLPNLNAHQLCAFIRSLE DDPSQSANLLAEAKKLNDAQAPK | 294 |
| ABPP284 | AGGETVYFPNLNADQLCAFIQSLEDDPSQSANLLAEAKKLNDAQAPASSSSGSSSSGRASAGGEIVYFPNLNADQLCAFIQSLE DDPSQSANLLAEAKKLNDAQAPK | 295 |
| ABPP285 | AGGETVYFPNLNADQLCAFIRSLEDDPSQSANLLAEAKKLNDAQAPASSSSGSSSSGRASAGGERVYLPNLNADQLCAFIRSLE DDQSQANLLAEAKKLNDAQAPK | 296 |
| ABPP286 | AGRERVYLPNLNADQLCAFIRSLEDDESQSANLLAEAKKLNDAQAPASSSSGSSSSGRASAGGEQVYLPNLNADQLCAFIRSLE DDPSQSANLLAEAKKLNDAQAPK | 297 |
| ABPP287 | AGGERVYLPNLNADQLCAFIRSLEDDPSQSANLLAEAKKLNDAQAPASSSSGSSSSGRASAGGETVVYFPNLNADQLCAFIRSLE DDPSQSANLLAEAKKLNDAQAPK | 298 |
| ABPP288 | AGGETVYFPNLNADQLCAFIRSLEDDPSQSANLLAEAKKLNDAQAPASSSSGSSSSGRASAGGERVYLPNLNAHQLCAFIQSLE DDPSQSANLLAEAKKLNDAQAPK | 299 |
| ABPP289 | AGGERVYLPNLNADQLCAFIRSLEDDPSQRANLLAEAKKLNDAQAPASSSSGSSSSGRASAGGERVYLPNLNAHQLCAFIRSLE DDPSORANLLAEAKKLNDAQAPK | 300 |
| ABPP290 | AGGERVYLPNLNADQLCAFIRSLEDDPSQSANLLAEAKKLNDAQAPASSSSGSSSSGRASAGGEIVYFPNLNAHQLCAFIRSLE DDPSQSANLLAEAKKLNDAQAPK | 301 |
| ABPP291 | AGGETVYFPNLNADQLCAFIRSLEDDPSQSANLLAEAKKLNDAQAPASSSSGSSSSGRASAGGEYVVLPNLNAHQLCAFIRSLE DDPSQSANLLAEAKKLNDAQAPK | 302 |
| ABPP292 | AGGETVYFPNLNADQLCAFINSLEDDPSQSANLLAEAKKLNDAQAPASSSSGSSSSGRASAGGETVYFPNLNADQLCAFIRSLE DDPSQSANLLAEAKKLNDAQAPK | 303 |
| ABPP293 | AGGETVYFPNLNADQLCAFIRSLEDDPSQRANLLAEAKKLNDAQAPASSSSGSSSSGRASAGRERVYLPNLNAHQLCAFIRSLE DDRSQRANLLAEAKKLNDAQAPK | 304 |
| ABPP294 | AGRERVYLPNLNADQLCAFIRSLEDDPSQSANLLAEAKKLNDAQAPASSSSGSSSSGRASAGGETVYFPNLNADQLCAFIRSLE DDPSQSANLLAEAKKLNDAQAPK | 305 |
| ABPP295 | AGGERVYLPNLNADQLCAFIRSLEDDPSQSANLLAEAKKLNDAQAPASSSSGSSSSGRASAGGETVYFPNLNADQLCAFIRSLE DDPSQSANLLAEAKKLNDAQAPK | 306 |
| ABPP296 | AGGERVYLPNLNADQLCAFIQSLEDDPSQNANLLAEAKKLNDAQAPASSSSGSSSSGRASAGGEMVYLPNLNADQLCAFIRSLE DDPSQSANLLAEAKKLNDAQAPK | 307 |
| ABPP297 | AGGEVYFPNLNADQLCAFIRSLEDDPSQSANLLAEAKKLNDAQAPASSSSGSSSSGRASAGGETVYLPNLNADQLCAFIQSLE DDPSQSANLLAEAKKLNDAQAPK | 308 |
| ABPP298 | AGGEMVYLPNLNADQLCAFIRSLEDDPSQSANLLAEAKKLNDAQAPASSSSGSSSSGRASAGGEMVYLPNLNAHQLCAFIRSLE DDPSQSANLLAEAKKLNDAQAPK | 309 |
| ABPP299 | AGGERVYLPNLNADQLCAFIRSLEDDPSQSANLLAEAKKLNDAQAPASSSSGSSSSGRASAGGETVVYLPNLNADQLCAFIRSLE DDSSQSANLLAEAKKLNDAQAPK | 310 |
| ABPP300 | AGGERVYLPNLNADQLCAFIRSLEDDPSQSANLLAEAKKLNDAQAPASSSSGSSSSGRASAGGEIVYLPNLNAHQLCAFIRSLE | 311 |

FIG. 1N

| NAME | SEQUENCE | SEQ ID NO: |
|---|---|---|
| ABPP301 | AGGERVYLPNLNADQLCAFIQSLEDDPSQSANLLAEAKKLNDAQAPASSSSGGSSSSGRASAGGERVYLPNLNAHQLCAFIQSLE DDRSQSANLLAEAKKLNDAQAPK | 312 |
| ABPP302 | AGGERVYLPNLNADQLCAFIRSLEDDPSQNANLLAEAKKLNDAQAPASSSSGSSSSGRASAGRERVYLPNLNADQLCAFIQSLE DDPSQSANLLAEAKKLNDAQAPK | 313 |
| ABPP303 | AGGEIVYFPNLNAHQLCAFINSLEDDPSQSANLLAEAKKLNDAQAPASSSSGSSSSSGRASAGGEIVYLPNLNAHQLCAFIQSLE DDPSQSANLLAEAKKLNDAQAPK | 314 |
| ABPP304 | AGGEIVYFPNLNADQLCAFIRSLEDDSSQSANLLAEAKKLNDAQAPASSSSGSSSSSGRASAGRERVYLPNLNADQLCAFIRSLE DDPSQQANLLAEAKKLNDAQAPK | 315 |
| ABPP305 | AGGEIVYFPNLNAHQLCAFIRSLEDDPSQSANLLAEAKKLNDAQAPASSSSGSSSSGRASAGGEMVYLPNLNAHQLCAFINSLE DDPSQSANLLAEAKKLNDAQAPK | 316 |
| ABPP306 | AGGEIVYFTNLNADQLCAFIRSLEDDESQSANLLAEAKKLNDAQAPASSSSGSSSSSGRASAGGEIVYLPNLNAHQLCAFIRSLE DDPSQSANLLAEAKKLNDAQAPK | 317 |
| ABPP307 | AGGEIVYLPNLNADQLCAFIRSLEDDPSQSANLLAEAKKLNDAQAPASSSSGSSSSSGRASAGRERVYLPNLNADQLCAFIRSLE DDPSQSANLLAEAKKLNDAQAPK | 318 |
| ABPP308 | AGGEIVYFPNLNADQLCAFIRSLEDDPSQNANLLAEAKKLNDAQAPASSSSGSSSSSGRASAGGERVYLPNLNADQLCAFIQSLE DDPSQSANLLAEAKKLNDAQAPK | 319 |
| ABPP309 | AGGEIVYFPNLNADQLCAFIRSLEDDPSQQANLLAEAKKLNDAQAPASSSSGSSSSSGRASAGAGEMVYLPNLNADQLCAFIRSLE DDSSQNANLLAEAKKLNDAQAPK | 320 |
| ABPP310 | AGGERVYLTNLNADQLCAFIRSLEDDPSQSANLLAEAKKLNDAQAPASSSSGSSSSGRASAGRERVYLPNLNADQLCAFIRSLE DDPSQRANLLAEAKKLNDAQAPK | 321 |
| ABPP311 | AGGEIVYLPNLNADQLCAFIRSLEDDPSQSANLLAEAKKLNDAQAPASSSSGSSSSGRASAGGEIVYLPNLNAHQLCAFIRSLE DDPSQSANLLAEAKKLNDAQAPK | 322 |
| ABPP312 | AGGEIVYLPNLNAHQLCAFIQSLEDDRSQSANLLAEAKKLNDAQAPASSSSGSSSSGRASAGGEIVYLPNLNAHQLCAFIRSLE DDRSQSANLLAEAKKLNDAQAPK | 323 |
| ABPP313 | AGGEIVYFPNLNADQLCAFIRSLEDDRSQSANLLAEAKKLNDAQAPASSSSGSSSSSGRASAGGEIVYFPNLNADQLCAFIRSLE DDPSQSANLLAEAKKLNDAQAPK | 324 |
| ABPP314 | AGREQVYLPNLNADQLCAFIRSLEDDPSQSANLLAEAKKLNDAQAPASSSSGSSSSSGRASAGGEQVYLPNLNADQLCAFIRSLE DDPSQSANLLAEAKKLNDAQAPK | 325 |
| ABPP315 | AGGEIVYFPNLNADQLCAFIRSLEDDPSQSANLLAEAKKLNDAQAPASSSSGSSSSSGRASAGGEIVYFPNLNADQLCAFIRSLE DDPSQSANLLAEAKKLNDAQAPK | 326 |
| ABPP316 | AGRERVYLPNLNADQLCAFIRSLEDDPSQSANLLAEAKKLNDAQAPASSSSGSSSSSGRASAGGEIVYLPNLNADQLCAFIRSLE DDPSQSANLLAEAKKLNDAQAPK | 327 |
| ABPP317 | AGGERVYLPNLNADQLCAFIRSLEDDPSQSANLLAEAKKLNDAQAPASSSSGSSSSSGRASAGGEIVYLPNLNAHQLCAFIRSLE DDPSQSANLLAEAKKLNDAQAPK | 328 |
| ABPP318 | AGGEIVYFPNLNADQLCAFINSLEDDPSQSANLLAEAKKLNDAQAPASSSSGSSSSGRASAGGEIVYFPNLNADQLCAFIRSLE DDPSQQANLLAEAKKLNDAQAPK | 329 |
| ABPP319 | AGGERVYLPNLNADQLCAFIRSLEDDSSQNANLLAEAKKLNDAQAPASSSSGSSSSSGRASAGGEIVYLPNLNAHQLCAFIRSLE DDPSQSANLLAEAKKLNDAQAPK | 330 |
| ABPP320 | AGGEIVYFPNLNADQLCAFIRSLEDDPSQSANLLAEAKKLNDAQAPASSSSGSSSSSGRASAGGEIVYFPNLNADQLCAFIRSLE DDPSQSANLLAEAKKLNDAQAPK | 331 |
| ABPP321 | AGGEQVYLPNLNADQLCAFIRSLEDDPSQQANLLAEAKKLNDAQAPASSSSGSSSSSGRASAGGEIVYLPNLNAHQLCAFIRSLE DDPSQSANLLAEAKKLNDAQAPK | 332 |
| ABPP322 | AGGEIVYFPNLNADQLCAFIRSLEDDPSQSANLLAEAKKLNDAQAPASSSSGSSSSSGRASAGGEIVYFPNLNADQLCAFIRSLE DDPSQSANLLAEAKKLNDAQAPK | 333 |
| ABPP323 | AGRERVYLPNLNADQLCAFINSLEDDPSQQANLLAEAKKLNDAQAPASSSSGSSSSSGRASAGRERVYLPNLNADQLCAFIRSLE DDPSQSANLLAEAKKLNDAQAPK | 334 |
| ABPP324 | AGGERVYLPNLNADQLCAFINSLEDDPSQSANLLAEAKKLNDAQAPASSSSGSSSSSGRASAGGEIVYLPNLNADQLCAFIQSLE DDPSQSANLLAEAKKLNDAQAPK | 335 |

FIG. 1O

| NAME | SEQUENCE | SEQ ID NO: |
|---|---|---|
| ABPP325 | AGRERVYLPNLNADQLCAFIQSLEDDPSQSANLLAEAKKLNDAQAPASSSSGSSSSGRASAGGETVYFPNLNADQLCAFIRSLE DDPSQSANLLAEAKKLNDAQAPK | 336 |
| ABPP326 | AGGERVYLPNLNAHQLCAFIRSLEDDPSQSANLLAEAKKLNDAQAPASSSSGSSSSGRASAGGETVVLPNLNADQLCAFINSLE DDPSQSANLLAEAKKLNDAQAPK | 337 |
| ABPP327 | AGRERVYLPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 338 |
| ABPP328 | AGRERVYLPNLNADQLCAFIQSLEDDPSQSANLLAEAKKLNDAQAPASSSSGSSSSGRASAGGEMVYLPNLNADQLCAFIRSLE DDPSQSANLLAEAKKLNDAQAPK | 339 |
| ABPP329 | AGRERVYLPNLNADQLCAFIRSLEDDPSQSANLLAEAKKLNDAQAPASSSSGSSSSGRASAGRETVYFPNLNADQLCAFIQSLE DDPSQNANLLAEAKKLNDAQAPK | 340 |
| ABPP330 | AGRERVYLPNLNADQLCAFIQSLEDDRSQSANLLAEAKKLNDAQAPASSSSGSSSSGRASAGGETVYLPNLNADQLCAFINSLE DDPSQSANLLAEAKKLNDAQAPK | 341 |
| ABPP331 | AGGERVYLPNLNAHQLCAFINSLEDDPSQSANLLAEAKKLNDAQAPASSSSGSSSSGRASAGGETVYLPNLNAHQLCAFIQSLE DDPSQSANLLAEAKKLNDAQAPK | 342 |
| ABPP332 | AGRERVYLPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 343 |
| ABPP333 | AGRERVYLRMLNADQLCAFIQSLEDDPSQSANLLAEAKKLNDAQAPASSSSGSSSSGRASAGGEIVYLPNLNADQLCAFIRSLE DDQSQSANLLAEAKKLNDAQAPK | 344 |
| ABPP334 | AGRERVYLPNLNADQLCAFIRSLEDDPSQSANLLAEAKKLNDAQAPASSSSGSSSSGRASAGGETVYLPNLNAHQLCAFIRSLE DDPSQSANLLAEAKKLNDAQAPK | 345 |
| ABPP335 | AGGETVYLPNLNADQLCAFIQSLEDDRSQSANLLAEAKKLNDAQAPASSSSGSSSSGRASAGGEMVYFPNLNADQLCAFIRSLE DDPSQSANLLAEAKKLNDAQAPK | 346 |
| ABPP336 | AGRERVYLPNLNADQLCAFIRSLEDDPSQSANLLAEAKKLNDAQAPASSSSGSSSSGRASAGGETVYFPNLNADQLCAFIRSLE DDPSQSANLLAEAKKLNDAQAPK | 347 |
| ABPP337 | AGRERVYLPNLNADQLCAFIRSLEDDPSQSANLLAEAKKLNDAQAPASSSSGSSSSGRASAGGEMVYLPNLNADQLCAFIRSLE DDPSQSANLLAEAKKLNDAQAPK | 348 |
| ABPP338 | AGRERVYLPNLNADQLCAFIRSLEDDESQSANLLAEAKKLNDAQAPASSSSGSSSSGRASAGGETVYLPNLNADQLCAFIRSLE DDPSQSANLLAEAKKLNDAQAPK | 349 |
| ABPP339 | AGGEMVYLPNLNADQLCAFIRSLEDDPSQNANLLAEAKKLNDAQAPASSSSGSSSSGRASAGGERVYLPNLNADQLCAFIRSLE DDQSQSANLLAEAKKLNDAQAPK | 350 |
| ABPP340 | AGRERVYLPNLNADQLCAFIRSLEDDPSQSANLLAEAKKLNDAQAPASSSSGSSSSGRASAGGETVVLPNLNAHQLCAFINSLE DDPSQSANLLAEAKKLNDAQAPK | 351 |
| ABPP341 | AGGETVYLPNLNAHQLCAFIRSLEDDSSQSANLLAEAKKLNDAQAPASSSSGSSSSGRASAGGEIVYLPNLNADQLCAFIRSLE DDSSQNANLLAEAKKLNDAQAPK | 352 |
| ABPP342 | AGGETVYFPNLNADQLCAFIRSLEDDPSQSANLLAEAKKLNDAQAPASSSSGSSSSGRASAGGEMVYLPNLNADQLCAFIRSLE DDPSQSANLLAEAKKLNDAQAPK | 353 |
| ABPP343 | AGRERVYLPNLNADQLCAFIRSLEDDPSQSANLLAEAKKLNDAQAPASSSSGSSSSGRASAGGETVYLPNLNADQLCAFIRSLE DDPSQSANLLAEAKKLNDAQAPK | 354 |
| ABPP344 | AGRERVYLPNLNADQLCAFINSLEDDPSQSANLLAEAKKLNDAQAPASSSSGSSSSGRASAGGERVYLPNLNAHQLCAFINSLE DDPSQSANLLAEAKKLNDAQAPK | 355 |
| ABPP345 | AGRERVYLPNLNAHQLCAFIRSLEDDPSQSANLLAEAKKLNDAQAPASSSSGSSSSGRASAGGETVYFPNLNADQLCAFIRSLE DDPSQSANLLAEAKKLNDAQAPK | 356 |
| ABPP346 | AGGETVYLPNLNADQLCAFIRSLEDDPSQSANLLAEAKKLNDAQAPASSSSGSSSSGRASAGGERVYLPNLNADQLCAFIRSLE DDPSQSANLLAEAKKLNDAQAPK | 357 |
| ABPP347 | AGGETVYFPNLNAHQLCAFIRSLEDDPSQSANLLAEAKKLNDAQAPASSSSGSSSSGRASAGGERVVLPNLNADQLCAFIRSLE DDPSQSANLLAEAKKLNDAQAPK | 358 |
| ABPP348 | AGGETVYFPNLNAHQLCAFIQSLEDDPSQSANLLAEAKKLNDAQAPASSSSGSSSSGRASAGGERVYLPNLNADQLCAFIQSLE DDPSQSANLLAEAKKLNDAQAPK | 359 |

FIG. 1P

| NAME | SEQUENCE | SEQ ID NO: |
|---|---|---|
| ABPP349 | AGRERVYLPNLNADQLCAFIRSLEDDPSQSANLLAEAKKLNDAQAPASSSSGSSSSSGRASAGGETVYIPNLNADQLCAFIRSLE DDPSQSANLLAEAKKLNDAQAPK | 360 |
| ABPP350 | AGGETVYLPNLNADQLCAFIRSLEDDPSQSANLLAEAKKLNDAQAPASSSSGSSSSSGRASAGGERVYFPNLNAHQLCAFIRSLE DDPSQSANLLAEAKKLNDAQAPK | 361 |
| ABPP351 | AGGERVYLPNLNADQLCAFIRSLEDDSSQSANLLAEAKKLNDAQAPASSSSGSSSSSGRASAGGETVYFPNLNADQLCAFIRSLE DDRSQSANLLAEAKKLNDAQAPK | 362 |
| ABPP352 | AGGETVYLPNLNADQLCAFIQSLEDDQSQSANLLAEAKKLNDAQAPASSSSGSSSSSGRASAGGETVYLPNLNADQLCAFIRSLE DDPSQSANLLAEAKKLNDAQAPK | 363 |
| ABPP353 | AGGETVYFPNLNADQLCAFIQSLEDDPSQSANLLAEAKKLNDAQAPASSSSGSSSSSGRASAGGETVYLPNLNAHQLCAFIRSLE DDRSQSANLLAEAKKLNDAQAPK | 364 |
| ABPP354 | AGGETVYFRNLNADQLCAFIRSLEDDPSQNANLLAEAKKLNDAQAPASSSSGSSSSSGRASAGGETVYFPNLNADQLCAFIRSLE DDPSQSANLLAEAKKLNDAQAPK | 365 |
| ABPP355 | AGGETVYFPNLNADQLCAFIRSLEDDRSQSANLLAEAKKLNDAQAPASSSSGSSSSSGRASAGGETVYFPNLNADQLCAFIRSLE DDPSQSANLLAEAKKLNDAQAPK | 366 |
| ABPP356 | AGGERVYLPNLNADQLCAFIRSLEDDPSQSANLLAEAKKLNDAQAPASSSSGSSSSSGRASAGGETVYFPNLNADQLCAFIQSLE DDPSQSANLLAEAKKLNDAQAPK | 367 |
| ABPP357 | AGREYVLPNLNADQLCAFIRSLEDDPSQSANLLAEAKKLNDAQAPASSSSGSSSSSGRASAGGEIVYLPNLNADQLCAFIRSLE DDPSQNANLLAEAKKLNDAQAPK | 368 |
| ABPP358 | AGGEMVYLPNLNADQLCAFINSLEDDPSQSANLLAEAKKLNDAQAPASSSSGSSSSSGRASAGGEIVYLPNLNAHQLCAFIRSLE DDPSQSANLLAEAKKLNDAQAPK | 369 |
| ABPP359 | AGGETVYLPNLNADQLCAFIQSLEDDPSQQANLLAEAKKLNDAQAPASSSSGSSSSSGRASAGGERVYFPNLNADQLCAFIRSLE DDPSQQANLLAEAKKLNDAQAPK | 370 |
| ABPP360 | AGGETVLYNLNADQLCAFIRSLEDDESQSANLLAEAKKLNDAQAPASSSSGSSSSSGRASAGGETVYFPNLNADQLCAFIRSLE DDPSQNANLLAEAKKLNDAQAPK | 371 |
| ABPP361 | AGGETVYLPNLNADQLCAFIQSLEDDPSQSANLLAEAKKLNDAQAPASSSSGSSSSSGRASAGGETVYFPNLNADQLCAFIRSLE DDPSQSANLLAEAKKLNDAQAPK | 372 |
| ABPP362 | AGGERVYFPNLNADQLCAFIRSLEDDQSQSANLLAEAKKLNDAQAPASSSSGSSSSSGRASAGGEIVYFPNLNADQLCAFIRSLE DDPSQSANLLAEAKKLNDAQAPK | 373 |
| ABPP363 | AGGEIVYLPNLNADQLCAFIRSLEDDPSQSANLLAEAKKLNDAQAPASSSSGSSSSSGRASAGGEIVVLPNLNADQLCAFIRSLE DDPSQSANLLAEAKKLNDAQAPK | 374 |
| ABPP364 | AGGETVYFPNLNADQLCAFIRSLEDDPSQSANLLAEAKKLNDAQAPASSSSGSSSSSGRASAGGEIVYLPNLNADQLCAFIRSLE DDESQNANLLAEAKKLNDAQAPK | 375 |
| ABPP365 | AGGERVYLPNLNADQLCAFIQSLEDDPSQQANLLAEAKKLNDAQAPASSSSGSSSSSGRASAGRERVYLPNLNADQLCAFIRSLE DDPSQRANLLAEAKKLNDAQAPK | 376 |
| ABPP366 | AGGERVYFPNLNADQLCAFIQSLEDDPSQQANLLAEAKKLNDAQAPASSSSGSSSSSGRASAGRERVYLPNLNADQLCAFIRSLE DDPSQRANLLAEAKKLNDAQAPK | 377 |
| ABPP367 | AGGERVYLPNLNADQLCAFIRSLEDDPSQSANLLAEAKKLNDAQAPASSSSGSSSSSGRASAGRERVYLPNLNADQLCAFIRSLE DDPSQRANLLAEAKKLNDAQAPK | 378 |
| ABPP368 | AGGERVYFPNLNADQLCAFIQSLEDDPSQQANLLAEAKKLNDAQAPASSSSGSSSSSGRASAGRERVYLPNLNADQLCAFIQSLE DDPSQQANLLAEAKKLNDAQAPK | 379 |
| ABPP369 | AGGEQVYFPNLNADQLCAFIRSLEDDPSQSANLLAEAKKLNDAQAPASSSSGSSSSSGRASAGRERVYLPNLNADQLCAFIRSLE DDPSQRANLLAEAKKLNDAQAPK | 380 |
| ABPP370 | AGGETVYLTNLNADQLCAFINSLEDDPSQSANLLAEAKKLNDAQAPASSSSGSSSSSGRASAGRERVYLPNLNADQLCAFIRSLE DDPSQRANLLAEAKKLNDAQAPK | 381 |
| ABPP371 | AGGETVYFPNLNADQLCAFIRSLEDDPSQRANLLAEAKKLNDAQAPASSSSGSSSSSGRASAGRERVYLPNLNADQLCAFIQSIE DDPSQQANLLAEAKKLNDAQAPK | 382 |
| ABPP372 | AGGEIVYFPNLNADQLCAFIRSLEDDPSQQANLLAEAKKLNDAQAPASSSSGSSSSSGRASAGRERVYLPNLNADQLCAFIQSIE DDPSQRANLLAEAKKLNDAQAPK | 383 |

FIG. 1Q

| NAME | SEQUENCE | SEQ ID NO: |
|---|---|---|
| ABPP373 | AGGERVYFPNLNADQLCAFIQSLEDDPSQSANLLAEAKKLNDAQAPASSSSGSSSSSGRASAGREQVYLPNLNADQLCAFIRSLE DDPSQQANLLAEAKKLNDAQAPK | 384 |
| ABPP374 | AGGERVYLPNLNADQLCAFIQSLEDDPSQSANLLAEAKKLNDAQAPASSSSGSSSSSGRASAGRERVYLPNLNADQLCAFIRSLE DDPSQQANLLAEAKKLNDAQAPK | 385 |
| ABPP375 | AGGETVYFPNLNAHQLCAFIQSLEDDPSQSANLLAEAKKLNDAQAPASSSSGSSSSSGRASAGRERVYLPNLNAHQLCAFIQSLE DDPSQQANLLAEAKKLNDAQAPK | 386 |
| ABPP376 | AGGETVYLPNLNADQLCAFIQSLEDDPSQSANLLAEAKKLNDAQAPASSSSGSSSSSGRASAGRERVYLPNLNAHQLCAFIRSLE DDPSQQANLLAEAKKLNDAQAPK | 387 |
| ABPP377 | AGGERVYLPNLNADQLCAFIRSLEDDPSQSANLLAEAKKLNDAQAPASSSSGSSSSSGRASAGGEMVYLPNLNAHQLCAFIQSLE DDPSQSANLLAEAKKLNDAQAPK | 388 |
| ABPP378 | AGGETVYFPNLNADQLCAFIQSLEDDPSQSANLLAEAKKLNDAQAPASSSSGSSSSSGRASAGRERVYLPNLNADQLCAFIRSLE DDQSQQANLLAEAKKLNDAQAPK | 389 |
| ABPP379 | AGGETVYFPNLNADQLCAFIQSLEDDPSQSANLLAEAKKLNDAQAPASSSSGSSSSSGRASAGRERVYLPNLNADQLCAFIQSLE DDPSQSANLLAEAKKLNDAQAPK | 390 |
| ABPP380 | AGGETVYLPNLNADQLCAFIQSLEDDPSQSANLLAEAKKLNDAQAPASSSSGSSSSSGRASAGRERVYLPNLNAHQLCAFIRSLE DDPSQSANLLAEAKKLNDAQAPK | 391 |
| ABPP381 | AGGETVYFPNLNADQLCAFIRSLEDDPSQSANLLAEAKKLNDAQAPASSSSGSSSSSGRASAGRERVYLPNLNADQLCAFIQSLE DDRSQQANLLAEAKKLNDAQAPK | 392 |
| ABPP382 | AGGERVYFPNLNADQLCAFIRSLEDDPSQSANLLAEAKKLNDAQAPASSSSGSSSSSGRASAGGETVYFPNLNADQLCAFIQSLE DDPSQRANLLAEAKKLNDAQAPK | 393 |
| ABPP383 | AGGETVYFPNLNADQLCAFIQSLEDDPSQSANLLAEAKKLNDAQAPASSSSGSSSSSGRASAGRERVYLPNLNADQLCAFIRSLE DDPSQRANLLAEAKKLNDAQAPK | 394 |
| ABPP384 | AGGEMVYLPNLNAHQLCAFIQSLEDDPSQQANLLAEAKKLNDAQAPASSSSGSSSSSGRASAGRERVYLPNLNADQLCAFIRSLE DDPSQQANLLAEAKKLNDAQAPK | 395 |
| ABPP385 | AGGETVYFPNLNADQLCAFIRSLEDDPSQQANLLAEAKKLNDAQAPASSSSGSSSSSGRASAGRERVYLPNLNADQLCAFIQSLE DDPSQRANLLAEAKKLNDAQAPK | 396 |
| ABPP386 | AGGETVYFPNLNADQLCAFIRSLEDDPSQQANLLAEAKKLNDAQAPASSSSGSSSSSGRASAGRERVYLPNLNAHQLCAFIQSLE DDRSQQANLLAEAKKLNDAQAPK | 397 |
| ABPP387 | AGGETVYFPNLNADQLCAFIRSLEDDPSQQANLLAEAKKLNDAQAPASSSSGSSSSSGRASAGRERVYLPNLNADQLCAFIRSLE DDRSQQANLLAEAKKLNDAQAPK | 398 |
| ABPP388 | AGGETHYFPNLNADQLCAFIQSLEDDPSQSANLLAEAKKLNDAQAPASSSSGSSSSSGRASAGRERVYLPNLNADQLCAFIRSLE DDPSQSANLLAEAKKLNDAQAPK | 399 |
| ABPP389 | AGGERVYFPNLNADQLCAFIQSLEDDPSQSANLLAEAKKLNDAQAPASSSSGSSSSSGRASAGRERVYLPNLNADQLCAFIRSLE DDRSQSANLLAEAKKLNDAQAPK | 400 |
| ABPP390 | AGGETVYLPNLNADQLCAFIRSLEDDPSQQANLLAEAKKLNDAQAPASSSSGSSSSSGRASAGRERVYLPNLNADQLCAFIRSLE DDPSQQANLLAEAKKLNDAQAPK | 401 |
| ABPP391 | AGGETHYFPNLNADQLCAFIRSLEDDPSQQANLLAEAKKLNDAQAPASSSSGSSSSSGRASAGRERVYLPNLNAHQLCAFIRSIE DDPSQQANLLAEAKKLNDAQAPK | 402 |
| ABPP392 | AGGETVYFPNLNADQLCAFIRSLEDDPSQQANLLAEAKKLNDAQAPASSSSGSSSSSGRASAGRERVYLPNLNAHQLCAFIQSLE DDPSQQANLLAEAKKLNDAQAPK | 403 |
| ABPP393 | AGGETVYFPNLNADQLCAFIRSLEDDPSQQANLLAEAKKLNDAQAPASSSSGSSSSSGRASAGRERVYLPNLNADQLCAFIRSLE DDRSQQANLLAEAKKLNDAQAPK | 404 |
| ABPP394 | AGGETVYFPNLNADQLCAFIRSLEDDPSQQANLLAEAKKLNDAQAPASSSSGSSSSSGRASAGRERVYLPNLNAHQLCAFIRSLE DDPSQSANLLAEAKKLNDAQAPK | 405 |
| ABPP395 | AGGERVYLPNLNADQLCAFIRSLEDDPSQQANLLAEAKKLNDAQAPASSSSGSSSSSGRASAGRERVYLPNLNADQLCAFIRSIE DDPSQQANLLAEAKKLNDAQAPK | 406 |
| ABPP396 | AGGERVYLPNLNADQLCAFIRSLEDDPSQQANLLAEAKKLNDAQAPASSSSGSSSSSGRASAGRERVYLPNLNADQLCAFIRSLE DDPSQQANLLAEAKKLNDAQAPK | 407 |

FIG. 1R

| NAME | SEQUENCE | SEQ ID NO: |
|---|---|---|
| ABPP397 | AGGETVYLPNLNADQLCAFIRSLEDDPSQSANLLAEAKKLNDAQAPASSSSGSSSSGRASAGRERVYLPNLNADQLCAFIRSLE<br>DDSSQQANLLAEAKKLNDAQAPK | 408 |
| ABPP398 | AGGERVYLPNLNAHQLCAFIRSLEDDPSQSANLLAEAKKLNDAQAPASSSSGSSSSGRASAGRERVYLPNLNADQLCAFIRSLE<br>DDRSQQANLLAEAKKLNDAQAPK | 409 |
| ABPP399 | AGGETVYFPNLNADQLCAFIQSLEDDPSQSANLLAEAKKLNDAQAPASSSSGSSSSGRASAGRERVYLPNLNADQLCAFIRSLE<br>DDSSQQANLLAEAKKLNDAQAPK | 410 |
| ABPP400 | AGGETVYLPNLNADQLCAFIRSLEDDPSQSANLLAEAKKLNDAQAPASSSSGSSSSGRASAGRERVYLPNLNADQLCAFIRSLE<br>DDPSQRANLLAEAKKLNDAQAPK | 411 |
| ABPP401 | AGGERVYLPNLNADQLCAFIRSLEDDPSQSANLLAEAKKLNDAQAPASSSSGSSSSGRASAGRERVYLPNLNADQLCAFIRSLE<br>DDRSQQANLLAEAKKLNDAQAPK | 412 |
| ABPP402 | AGGERVYLTNLNADQLCAFIRSLEDDPSQQANLLAEAKKLNDAQAPASSSSGSSSSGRASAGRERVYLPNLNADQLCAFIRSLE<br>DDRSQQANLLAEAKKLNDAQAPK | 413 |
| ABPP403 | AGGETVYLPNLNADQLCAFIQSLEDDPSQSANLLAEAKKLNDAQAPASSSSGSSSSGRASAGETVYFPNLNAHQLCAFIRSLE<br>DDPSQSANLLAEAKKLNDAQAPK | 414 |
| ABPP404 | AGGETVYFPNLNADQLCAFIQSLEDDPSQSANLLAEAKKLNDAQAPASSSSGSSSSGRASAGRERVYLPNLNADQLCAFIRSLE<br>DDRSQQANLLAEAKKLNDAQAPK | 415 |
| ABPP405 | AGGETVYLPNLNADQLCAFIQSLEDDPSQQANLLAEAKKLNDAQAPASSSSGSSSSGRASAGRERVYLPNLNADQLCAFIRSLE<br>DDPSQSANLLAEAKKLNDAQAPK | 416 |
| ABPP406 | AGGETVYLPNLNADQLCAFIRSLEDDPSQSANLLAEAKKLNDAQAPASSSSGSSSSGRASAGRERVYLPNLNADQLCAFIRSLE<br>DDRSQQANLLAEAKKLNDAQAPK | 417 |
| ABPP407 | AGGERVYLTNLNADQLCAFIRSLEDDPSQSANLLAEAKKLNDAQAPASSSSGSSSSGRASAGRERVYLPNLNADQLCAFIRSLE<br>DDPSQSANLLAEAKKLNDAQAPK | 418 |
| ABPP408 | AGGETVYFPNLNADQLCAFIRSLEDDPSQQANLLAEAKKLNDAQAPASSSSGSSSSGRASAGRERVYLPNLNADQLCAFIQSLE<br>DDPSQSANLLAEAKKLNDAQAPK | 419 |
| ABPP409 | AGGETVYFPNLNADQLCAFIRSLEDDPSQSANLLAEAKKLNDAQAPASSSSGSSSSGRASAGRERVYLPNLNAHQLCAFINSLE<br>DDPSQSANLLAEAKKLNDAQAPK | 420 |
| ABPP410 | AGGETVYFPNLNADQLCAFIQSLEDDPSQSANLLAEAKKLNDAQAPASSSSGSSSSGRASAGRERVYLPNLNAHQLCAFIQSLE<br>DDPSQSANLLAEAKKLNDAQAPK | 421 |
| ABPP411 | AGGERVYLPNLNADQLCAFIRSLEDDPSQSANLLAEAKKLNDAQAPASSSSGSSSSGRASAGRERVYLPNLNADQLCAFIRSLE<br>DDRSQQANLLAEAKKLNDAQAPK | 422 |
| ABPP412 | AGGETVYFPNLNADQLCAFIQSLEDDPSQQANLLAEAKKLNDAQAPASSSSGSSSSGRASAGRERVYLPNLNADQLCAFIRSLE<br>DDPSQSANLLAEAKKLNDAQAPK | 423 |
| ABPP413 | AGGETVYFPNLNADQLCAFIRSLEDDPSQQANLLAEAKKLNDAQAPASSSSGSSSSGRASAGRERVYLPNLNAHQLCAFIRSLE<br>DDPSQSANLLAEAKKLNDAQAPK | 424 |
| ABPP414 | AGGEQVYLPNLNADQLCAFIRSLEDDPSQQANLLAEAKKLNDAQAPASSSSGSSSSGRASAGRERVYLPNLNADQLCAFIRSLE<br>DDPSQSANLLAEAKKLNDAQAPK | 425 |
| ABPP415 | AGGETVYFPNLNADQLCAFIRSLEDDPSQQANLLAEAKKLNDAQAPASSSSGSSSSGRASAGRERVYLPNLNAHQLCAFIRSLE<br>DDPSQSANLLAEAKKLNDAQAPK | 426 |
| ABPP416 | AGGETVYFPNLNADQLCAFIQSLEDDPSQQANLLAEAKKLNDAQAPASSSSGSSSSGRASAGRERVYLPNLNADQLCAFIRSLE<br>DDRSQQANLLAEAKKLNDAQAPK | 427 |
| ABPP417 | AGGETVYFPNLNAHQLCAFIRSLEDDPSQQANLLAEAKKLNDAQAPASSSSGSSSSGRASAGGEQVYLPNLNADQLCAFIRSLE<br>DDPSQSANLLAEAKKLNDAQAPK | 428 |
| ABPP418 | AGGETVYFPNLNAHQLCAFIRSLEDDPSQQANLLAEAKKLNDAQAPASSSSGSSSSGRASAGRERVYLPNLNADQLCAFIRSLE<br>DDQSQRANLLAEAKKLNDAQAPK | 429 |
| ABPP419 | AGGETVYFPNLNAHQLCAFIRSLEDDPSQQANLLAEAKKLNDAQAPASSSSGSSSSGRASAGRERVYLPNLNADQLCAFIQSLE<br>DDPSQSANLLAEAKKLNDAQAPK | 430 |
| ABPP420 | AGGEIVYFPNLNAHQLCAFIRSLEDDPSQQANLLAEAKKLNDAQAPASSSSGSSSSGRASAGRERVYLPNLNADQLCAFIQSLE<br>DDPSQSANLLAEAKKLNDAQAPK | 431 |

FIG. 1S

| NAME | SEQUENCE | SEQ ID NO: |
|---|---|---|
| ABPP421 | AGGETVYLPNLNADQLCAFIRSLEDDPSQQANLLAEAKKLNDAQAPASSSSGSSSSGRASAGRERVYLPNLNADQLCAFIQSLE DDPSQSANLLAEAKKLNDAQAPK | 432 |
| ABPP422 | AGGETVYFPNLNADQLCAFINSLEDDPSQSANLLAEAKKLNDAQAPASSSSGSSSSGRASAGRERVYLPNLNADQLCAFIQSLE DDPSQSANLLAEAKKLNDAQAPK | 433 |
| ABPP423 | AGGETVYFPNLNADQLCAFIQSLEDDPSQQANLLAEAKKLNDAQAPASSSSGSSSSGRASAGRERVYLTNLNADQLCAFINSLE DDPSQSANLLAEAKKLNDAQAPK | 434 |
| ABPP424 | AGGETVYFPNLNAHQLCAFIRSLEDDPSQSANLLAEAKKLNDAQAPASSSSGSSSSGRASAGRERVYLPNLNADQLCAFIQSLE DDRSQRANLLAEAKKLNDAQAPK | 435 |
| ABPP425 | AGGETVYFPNLNADQLCAFIRSLEDDPSQSANLLAEAKKLNDAQAPASSSSGSSSSGRASAGREQVYLPNLNADQLCAFIQSIE DDPSQSANLLAEAKKLNDAQAPK | 436 |
| ABPP426 | AGGEQVYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 437 |
| ABPP427 | AGGERVYLPNLNADQLCAFIRSLEDDPSQQANLLAEAKKLNDAQAPASSSSGSSSSGRASAGRERVYLPNLNADQLCAFINSLE DDPSQSANLLAEAKKLNDAQAPK | 438 |
| ABPP428 | AGGETVYFPNLNADQLCAFIQSLEDDPSQQANLLAEAKKLNDAQAPASSSSGSSSSGRASAGRERVYLPNLNADQLCAFIRSLE DDRSQRANLLAEAKKLNDAQAPK | 439 |
| ABPP429 | AGGERVYLTNLNADQLCAFIRSLEDDPSQQANLLAEAKKLNDAQAPASSSSGSSSSGRASAGRERVVLPNLNADQLCAFIRSLE DDPSQRANLLAEAKKLNDAQAPK | 440 |
| ABPP430 | AGGETVYFPNLNADQLCAFIQSLEDDPSQSANLLAEAKKLNDAQAPASSSSGSSSSGRASAGRERVYLPNLNADQLCAFIRSLE DDPSQQANLLAEAKKLNDAQAPK | 441 |
| ABPP431 | AGGERVYFPNLNADQLCAFIRSLEDDPSQSANLLAEAKKLNDAQAPASSSSGSSSSGRASAGRERVYLPNLNADQLCAFIRSLE DDPSQSANLLAEAKKLNDAQAPK | 442 |
| ABPP432 | AGGETVYFPNLNAHQLCAFIRSLEDDPSQQANLLAEAKKLNDAQAPASSSSGSSSSGRASAGRERVYLPNLNADQLCAFINSIE DDPSQSANLLAEAKKLNDAQAPK | 443 |
| ABPP433 | AGGETVYFPNLNADQLCAFIQSLEDDPSQQANLLAEAKKLNDAQAPASSSSGSSSSGRASAGRERVYLPNLNADQLCAFIRSLE DDPSQSANLLAEAKKLNDAQAPK | 444 |
| ABPP434 | AGGERVYLPNLNADQLCAFINSLEDDPSQQANLLAEAKKLNDAQAPASSSSGSSSSGRASAGREQVYLPNLNAHQLCAFIRSIE DDPSQRANLLAEAKKLNDAQAPK | 445 |
| ABPP435 | AGGETVYFPNLNADQLCAFIRSLEDDPSQQANLLAEAKKLNDAQAPASSSSGSSSSGRASAGRERVYLPNLNADQLCAFINSLE DDPSQSANLLAEAKKLNDAQAPK | 446 |
| ABPP436 | AGGETVYFPNLNADQLCAFIQSLEDDPSQQANLLAEAKKLNDAQAPASSSSGSSSSGRASAGRERVYLPNLNAHQLCAFIRSLE DDPSQSANLLAEAKKLNDAQAPK | 447 |
| ABPP437 | AGGETVYFPNLNAHQLCAFIRSLEDDPSQQANLLAEAKKLNDAQAPASSSSGSSSSGRASAGRERVYLPNLNAHQLCAFIQSLE DDPSQSANLLAEAKKLNDAQAPK | 448 |
| ABPP438 | AGGETVYFPNLNADQLCAFIRSLEDDPSQQANLLAEAKKLNDAQAPASSSSGSSSSGRASAGREQVYLPNLNADQLCAFIRSIE DDPSQRANLLAEAKKLNDAQAPK | 449 |
| ABPP439 | AGGETVYFPNLNADQLCAFIRSLEDDPSQSANLLAEAKKLNDAQAPASSSSGSSSSGRASAGRERVYLPNLNADQLCAFIQSLE DDPSQSANLLAEAKKLNDAQAPK | 450 |
| ABPP440 | AGGETVYLPNLNADQLCAFIQSLEDDPSQQANLLAEAKKLNDAQAPASSSSGSSSSGRASAGRERVYLPNLNAHQLCAFIRSLE DDPSQQANLLAEAKKLNDAQAPK | 451 |
| ABPP441 | AGGETVYFPNLNADQLCAFIQSLEDDPSQSANLLAEAKKLNDAQAPASSSSGSSSSGRASAGRERVYLPNLNAHQLCAFIRSLE DDPSQSANLLAEAKKLNDAQAPK | 452 |
| ABPP442 | AGGETVYFPNLNADQLCAFIRSLEDDPSQQANLLAEAKKLNDAQAPASSSSGSSSSGRASAGRERVYLPNLNADQLCAFIQSLE DDPSQSANLLAEAKKLNDAQAPK | 453 |
| ABPP443 | AGGERVYLTNLNADQLCAFIRSLEDDPSQSANLLAEAKKLNDAQAPASSSSGSSSSGRASAGRERVYLPNLNADQLCAFIQSLE DDPSQSANLLAEAKKLNDAQAPK | 454 |
| ABPP444 | AGGERVYLPNLNADQLCAFIRSLEDDPSQRANLLAEAKKLNDAQAPASSSSGSSSSGRASAGRERVYLPNLNADQLCAFIRSLE DDPSQRANLLAEAKKLNDAQAPK | 455 |

FIG. 1T

| NAME | SEQUENCE | SEQ ID NO: |
|---|---|---|
| ABPP445 | AGGERVYLTNLNADQLCAFIRSLEDDPSQQANLLAEAKKLNDAQAPASSSSGSSSSGRASAGRERVYLPNLNADQLCAFIQSLE DDPSQRANLLAEAKKLNDAQAPK | 456 |
| ABPP446 | AGGEQVYLTNLNADQLCAFIRSLEDDPSQSANLLAEAKKLNDAQAPASSSSGSSSSGRASAGRERVYLPNLNADQLCAFIQSLE DDPSQQANLLAEAKKLNDAQAPK | 457 |
| ABPP447 | AGGERVYLRNLNADQLCAFINSLEDDPSQSANLLAEAKKLNDAQAPASSSSGSSSSGRASAGRETVYLPNLNADQLCAFIRSLE DDPSQQANLLAEAKKLNDAQAPK | 458 |
| ABPP448 | AGGEMVYLPNLNADQLCAFIRSLEDDPSQQANLLAEAKKLNDAQAPASSSSGSSSSGRASAGRERVYLPNLNADQLCAFIQSLE DDPSQQANLLAEAKKLNDAQAPK | 459 |
| ABPP449 | AGGETVYFPNLNAHQLCAFIQSLEDDPSQQANLLAEAKKLNDAQAPASSSSGSSSSGRASAGRERVYLPNLNADQLCAFIRSLE DDPSQQANLLAEAKKLNDAQAPK | 460 |
| ABPP450 | AGGERVYFTNLNADQLCAFIQSLEDDPSQSANLLAEAKKLNDAQAPASSSSGSSSSGRASAGRERVYLPNLNADQLCAFIRSIE DDPSQRANLLAEAKKLNDAQAPK | 461 |
| ABPP451 | AGGERVYFTNLNADQLCAFIRSLEDDPSQQANLLAEAKKLNDAQAPASSSSGSSSSGRASAGRERVYLPNLNADQLCAFIRSIE DDPSQQANLLAEAKKLNDAQAPK | 462 |
| ABPP452 | AGGERVYFPNLNADQLCAFIRSLEDDPSQQANLLAEAKKLNDAQAPASSSSGSSSSGRASAGREQVLPNLNADQLCAFIRSLE DDPSQQANLLAEAKKLNDAQAPK | 463 |
| ABPP453 | AGGETVYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 464 |
| ABPP454 | AGGETVYFPNLNAHQLCAFIQSLEDDPSQQANLLAEAKKLNDAQAPASSSSGSSSSGRASAGRERVYLPNLNADQLCAFIRSLE DDPSQQANLLAEAKKLNDAQAPK | 465 |
| ABPP455 | AGGETVYFPNLNADQLCAFIQSLEDDPSQQANLLAEAKKLNDAQAPASSSSGSSSSGRASAGRERVYLPNLNADQLCAFIRSFE DDRSQQANLLAEAKKLNDAQAPK | 466 |
| ABPP456 | AGGETHYFPNLNADQLCAFIRSLEDDPSQQANLLAEAKKLNDAQAPASSSSGSSSSGRASAGRERVYLPNLNADQLCAFIQSLE DDRSQQANLLAEAKKLNDAQAPK | 467 |
| ABPP457 | AGGETVYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 468 |
| ABPP458 | AGGETVYFPNLNADQLCAFIRSLEDDPSQQANLLAEAKKLNDAQAPASSSSGSSSSGRASAGRERVYLPNLNADQLCAFINSIE DDPSQRANLLAEAKKLNDAQAPK | 469 |
| ABPP459 | AGGETVYFPNLNADQLCAFIRSLEDDPSQQANLLAEAKKLNDAQAPASSSSGSSSSGRASAGRERVYLPNLNADQLCAFIQSLE DDPSQRANLLAEAKKLNDAQAPK | 470 |
| ABPP460 | AGGETVYFPNLNADQLCAFIRSLEDDPSQQANLLAEAKKLNDAQAPASSSSGSSSSGRASAGRERVYLPNLNADQLCAFIQSLE DDPSQQANLLAEAKKLNDAQAPK | 471 |
| ABPP461 | AGGETVYFPNLNADQLCAFIRSLEDDPSQQANLLAEAKKLNDAQAPASSSSGSSSSGRASAGRERVYLPNLNADQLCAFIRSLE DDPSQSANLLAEAKKLNDAQAPK | 472 |
| ABPP462 | AGGETVYFPNLNADQLCAFIRSLEDDPSQQANLLAEAKKLNDAQAPASSSSGSSSSGRASAGRERVYLPNLNADQLCAFIRSLE DDPSQSANLLAEAKKLNDAQAPK | 473 |
| ABPP463 | AGGERVYLPNLNADQLCAFIQSLEDDPSQQANLLAEAKKLNDAQAPASSSSGSSSSGRASAGRERVYLPNLNADQLCAFIRSLE DDPSQSANLLAEAKKLNDAQAPK | 474 |
| ABPP464 | AGGETVYFPNLNADQLCAFIRSLEDDPSQQANLLAEAKKLNDAQAPASSSSGSSSSGRASAGGEQVYLPNLNADQLCAFIRSLE DDPSQSANLLAEAKKLNDAQAPK | 475 |
| ABPP465 | AGGERVYLPNLNADQLCAFIRSLEDDPSQQANLLAEAKKLNDAQAPASSSSGSSSSGRASAGRERVYLPNLNAHQLCAFIRSLE DDPSQSANLLAEAKKLNDAQAPK | 476 |
| ABPP466 | AGGETVYFPNLNADQLCAFIRSLEDDPSQQANLLAEAKKLNDAQAPASSSSGSSSSGRASAGRERVYLPNLNADQLCAFIRSLE DDPSQSANLLAEAKKLNDAQAPK | 477 |
| ABPP467 | AGGERVYLPNLNADQLCAFIRSLEDDPSQSANLLAEAKKLNDAQAPASSSSGSSSSGRASAGRERVYLPNLNADQLCAFIRSLE DDPSQQANLLAEAKKLNDAQAPK | 478 |
| ABPP468 | AGGERVYLPNLNAHQLCAFIRSLEDDPSQQANLLAEAKKLNDAQAPASSSSGSSSSGRASAGRERVYLPNLNADQLCAFIQSIE DDPSQQANLLAEAKKLNDAQAPK | 479 |

FIG. 1U

| NAME | SEQUENCE | SEQ ID NO: |
|---|---|---|
| ABPP469 | AGGETVYFPNLNAHQLCAFIRSLEDDPSQQANLLAEAKKLNDAQAPASSSSGSSSSGRASAGRERVYLPNLNADQLCAFIRSLE DDPSQQANLLAEAKKLNDAQAPK | 480 |
| ABPP470 | AGGETVYFPNLNAHQLCAFIQSLEDDPSQQANLLAEAKKLNDAQAPASSSSGSSSSGRASAGRERVYLPNLNADQLCAFINSLE DDSSQQANLLAEAKKLNDAQAPK | 481 |
| ABPP471 | AGGETVYFPNLNAHQLCAFIRSLEDDPSQQANLLAEAKKLNDAQAPASSSSGSSSSGRASAGRERVYLPNLNADQLCAFIRSLE DDPSQQANLLAEAKKLNDAQAPK | 482 |
| ABPP472 | AGGETVYFPNLNADQLCAFIQSLEDDPSQSANLLAEAKKLNDAQAPASSSSGSSSSGRASAGGEQVYLPNLNADQLCAFIRSLE DDPSQQANLLAEAKKLNDAQAPK | 483 |
| ABPP473 | AGGERVYLTNLNADQLCAFIQSLEDDPSQSANLLAEAKKLNDAQAPASSSSGSSSSGRASAGRERVYLPNLNAHQLCAFIRSLE DDPSQQANLLAEAKKLNDAQAPK | 484 |
| ABPP474 | AGGETVYLPNLNAHQLCAFIQSLEDDPSQQANLLAEAKKLNDAQAPASSSSGSSSSGRASAGRERVYLPNLNADQLCAFIRSLE DDPSQQANLLAEAKKLNDAQAPK | 485 |
| ABPP475 | AGGETVYFPNLNAHQLCAFIQSLEDDPSQSANLLAEAKKLNDAQAPASSSSGSSSSGRASAGRERVYLPNLNADQLCAFINSLE DDPSQQANLLAEAKKLNDAQAPK | 486 |
| ABPP476 | AGGERVYFPNLNAHQLCAFIQSLEDDPSQSANLLAEAKKLNDAQAPASSSSGSSSSGRASAGRERVYLPNLNADQLCAFIQSFE DDPSQQANLLAEAKKLNDAQAPK | 487 |
| ABPP477 | AGGETVYFPNLNAHQLCAFIQSLEDDPSQQANLLAEAKKLNDAQAPASSSSGSSSSGRASAGRERVYLPNLNAHQLCAFIRSLE DDPSQQANLLAEAKKLNDAQAPK | 488 |
| ABPP478 | AGGERVYFPNLNAHQLCAFIRSLEDDPSQQANLLAEAKKLNDAQAPASSSSGSSSSGRASAGRERVYLPNLNAHQLCAFIRSIE DDPSQRANLLAEAKKLNDAQAPK | 489 |
| ABPP479 | AGGETVYLPNLNAHQLCAFIRSLEDDPSQQANLLAEAKKLNDAQAPASSSSGSSSSGRASAGRERVYLPNLNADQLCAFIRSLE DDRSQRANLLAEAKKLNDAQAPK | 490 |
| ABPP480 | AGRERVYLPNLNAHQLCAFIRSLEDDPSQSANLLAEAKKLNDAQAPASSSSGSSSSGRASAGRERVYLPNLNADQLCAFIRSIE DDPSQRANLLAEAKKLNDAQAPK | 491 |
| ABPP481 | AGGETVYFPNLNAHQLCAFIQSLEDDPSQQANLLAEAKKLNDAQAPASSSSGSSSSGRASAGRETVYLPNLNADQLCAFIQSLE DDPSQQANLLAEAKKLNDAQAPK | 492 |
| ABPP482 | AGGERVYFPNLNAHQLCAFIQSLEDDPSQQANLLAEAKKLNDAQAPASSSSGSSSSGRASAGREQVYLPNLNADQLCAFIRSLE DDPSQQANLLAEAKKLNDAQAPK | 493 |
| ABPP483 | AGGERVYFPNLNAHQLCAFIQSLEDDPSQQANLLAEAKKLNDAQAPASSSSGSSSSGRASAGGEQVYLPNLNADQLCAFIQSLE DDPSQRANLLAEAKKLNDAQAPK | 494 |
| ABPP484 | AGGERVYFPNLNAFIQSLEDDPSQSANLLAEAKKLNDAQAPASSSSGSSSSGRASAGRERVYLPNLNADQLCAFIRSLE DDPSQQANLLAEAKKLNDAQAPK | 495 |
| ABPP485 | AGGETVYFPNLNADQLCAFIRSLEDDPSQQANLLAEAKKLNDAQAPASSSSGSSSSGRASAGRERVYLPNLNADQLCAFIRSLE DDPSQRANLLAEAKKLNDAQAPK | 496 |
| ABPP486 | AGGETVYFPNLNADQLCAFIRSLEDDPSQQANLLAEAKKLNDAQAPASSSSGSSSSGRASAGRERVYLPNLNADQLCAFIRSIE DDSSQRANLLAEAKKLNDAQAPK | 497 |
| ABPP487 | AGGETVYFPNLNADQLCAFIRSLEDDPSQSANLLAEAKKLNDAQAPASSSSGSSSSGRASAGRERVYLPNLNADQLCAFIRSLE DDPSQQANLLAEAKKLNDAQAPK | 498 |
| ABPP488 | AGGETVYFPNLNADQLCAFIQSLEDDPSQQANLLAEAKKLNDAQAPASSSSGSSSSGRASAGGEMVYLPNLNAHQLCAFIRSLE DDPSQQANLLAEAKKLNDAQAPK | 499 |
| ABPP489 | AGGETVYFPNLNADQLCAFIRSLEDDPSQQANLLAEAKKLNDAQAPASSSSGSSSSGRASAGGEQVYLPNLNADQLCAFIQSLE DDPSQRANLLAEAKKLNDAQAPK | 500 |
| ABPP490 | AGGERVYFPNLNADQLCAFIQSLEDDPSQQANLLAEAKKLNDAQAPASSSSGSSSSGRASAGRERVYLPNLNAHQLCAFIQSIE DDPSQQANLLAEAKKLNDAQAPK | 501 |
| ABPP491 | AGGETHYFPNLNADQLCAFIQSLEDDPSQSANLLAEAKKLNDAQAPASSSSGSSSSGRASAGRERVYLPNLNAHQLCAFIQSLE DDRSQQANLLAEAKKLNDAQAPK | 502 |
| ABPP492 | AGGETVYFPNLNADQLCAFIRSLEDDPSQSANLLAEAKKLNDAQAPASSSSGSSSSGRASAGRERVYLPNLNADQLCAFINSLE DDPSQQANLLAEAKKLNDAQAPK | 503 |

FIG. 1V

| NAME | SEQUENCE | SEQ ID NO: |
|---|---|---|
| ABPP493 | AGGETVYFPNLNADQLCAFIRSLEDDPSQQANLLAEAKKLNDAQAPASSSSGSSSSGRASAGRERVYLPNLNADQLCAFIQSLE DDPSQQANLLAEAKKLNDAQAPK | 504 |
| ABPP494 | AGGETVYFPNLNADQLCAFINSLEDDPSQQANLLAEAKKLNDAQAPASSSSGSSSSGRASAGRERVYLPNLNAHQLCAFIRSIE DDSSQQANLLAEAKKLNDAQAPK | 505 |
| ABPP495 | AGGERVYFPNLNADQLCAFIRSLEDDPSQQANLLAEAKKLNDAQAPASSSSGSSSSGRASAGRERVYLPNLNADQLCAFIRSIE DDPSQQANLLAEAKKLNDAQAPK | 506 |
| ABPP496 | AGGEQVYLTPNLNADQLCAFIRSLEDDPSQSANLLAEAKKLNDAQAPASSSSGSSSSGRASAGRERVYFPNLNAHQLCAFIRSLE DDPSQQANLLAEAKKLNDAQAPK | 507 |
| ABPP497 | AGGETVYLPNLNADQLCAFIQSLEDDPSQSANLLAEAKKLNDAQAPASSSSGSSSSGRASAGGETVYFPNLNAHQLCAFIRSLE DDSSQQANLLAEAKKLNDAQAPK | 508 |
| ABPP498 | AGGETHYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 509 |
| ABPP499 | AGGERVYFPNLNADQLCAFIQSLEDDPSQQANLLAEAKKLNDAQAPASSSSGSSSSGRASAGRERVYLPNLNAHQLCAFIRSIE DDPSQQANLLAEAKKLNDAQAPK | 510 |
| ABPP500 | AGGETHYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 511 |
| ABPP501 | AGGERVYFPNLNADQLCAFIRSLEDDPSQQANLLAEAKKLNDAQAPASSSSGSSSSGRASAGRERVYLPNLNAHQLCAFIQSLE DDRSQQANLLAEAKKLNDAQAPK | 512 |
| ABPP502 | AGGETVYFPNLNADQLCAFIRSLEDDPSQSANLLAEAKKLNDAQAPASSSSGSSSSGRASAGRERVYLPNLNADQLCAFIRSLE DDPSQSANLLAEAKKLNDAQAPK | 513 |
| ABPP503 | AGGETVYLPNLNADQLCAFIRSLEDDPSQQANLLAEAKKLNDAQAPASSSSGSSSSGRASAGRETVYLPNLNADQLCAFIRSLE DDRSQQANLLAEAKKLNDAQAPK | 514 |
| ABPP504 | AGGETVYLPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 515 |
| ABPP505 | AGGETVYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 516 |
| ABPP506 | AGGERVYFPNLNADQLCAFIRSLEDDPSQQANLLAEAKKLNDAQAPASSSSGSSSSGRASAGRERVYLPNLNADQLCAFIRSLE DDPSQQANLLAEAKKLNDAQAPK | 517 |
| ABPP507 | AGGETVYFPNLNADQLCAFIQSLEDDPSQQANLLAEAKKLNDAQAPASSSSGSSSSGRASAGRERVYLPNLNADQLCAFIRSLE DDPSQQANLLAEAKKLNDAQAPK | 518 |
| ABPP508 | AGGERVYFPNLNADQLCAFIQSLEDDPSQQANLLAEAKKLNDAQAPASSSSGSSSSGRASAGRERVYLPNLNADQLCAFIRSLE DDPSQRANLLAEAKKLNDAQAPK | 519 |
| ABPP509 | AGGETVYFPNLNADQLCAFIQSLEDDPSQQANLLAEAKKLNDAQAPASSSSGSSSSGRASAGRERVYLPNLNADQLCAFIQSLE DDPSQQANLLAEAKKLNDAQAPK | 520 |
| ABPP510 | AGGETVYLPNLNADQLCAFIRSLEDDPSQSANLLAEAKKLNDAQAPASSSSGSSSSGRASAGRERVYLPNLNADQLCAFIRSIE DDPSQRANLLAEAKKLNDAQAPK | 521 |
| ABPP511 | AGGERVYLPNLNAHQLCAFIRSLEDDPSQSANLLAEAKKLNDAQAPASSSSGSSSSGRASAGRERVYLPNLNAHQLCAFIRSLE DDRSQQANLLAEAKKLNDAQAPK | 522 |
| ABPP512 | AGGEMVYFPNLNADQLCAFIQSLEDDPSQQANLLAEAKKLNDAQAPASSSSGSSSSGRASAGRERVYLPNLNAHQLCAFIRSLE DDRSQQANLLAEAKKLNDAQAPK | 523 |
| ABPP513 | AGGERVYFPNLNADQLCAFIQSLEDDPSQQANLLAEAKKLNDAQAPASSSSGSSSSGRASAGRERVYLPNLNADQLCAFIRSLE DDPSQRANLLAEAKKLNDAQAPK | 524 |
| ABPP514 | AGGETHYFPNLNADQLCAFIQSLEDDPSQQANLLAEAKKLNDAQAPASSSSGSSSSGRASAGRERVYLPNLNAHQLCAFIRSLE DDPSQQANLLAEAKKLNDAQAPK | 525 |
| ABPP515 | AGGERVYLTPNLNADQLCAFIQSLEDDPSQQANLLAEAKKLNDAQAPASSSSGSSSSGRASAGRERVYLPNLNADQLCAFIRSLE DDPSQRANLLAEAKKLNDAQAPK | 526 |
| ABPP516 | AGGETVYLPNLNADQLCAFINSLEDDPSQSANLLAEAKKLNDAQAPASSSSGSSSSGRASAGGEQVYLPNLNADQLCAFIRSLE DDPSQSANLLAEAKKLNDAQAPK | 527 |

FIG. 1W

| NAME | SEQUENCE | SEQ ID NO: |
|---|---|---|
| ABPP517 | AGGETVYLPNLNADQLCAFIRSLEDDPSQQANLLAEAKKLNDAQAPASSSSGSSSSGRASAGREQVYLPNLNADQLCAFIRSLE DDPSQSANLLAEAKKLNDAQAPK | 528 |
| ABPP518 | AGGEQVYFNLNAHQLCAFIRSLEDDPSQQANLLAEAKKLNDAQAPASSSSGSSSSGRASAGRERVYLPNLNADQLCAFINSIE DDPSQSANLLAEAKKLNDAQAPK | 529 |
| ABPP519 | AGGETVYLPNLNADQLCAFIRSLEDDPSQQANLLAEAKKLNDAQAPASSSSGSSSSGRASAGRERVYLPNLNADQLCAFINSIE DDPSQSANLLAEAKKLNDAQAPK | 530 |
| ABPP520 | AGGEQVYFPNLNADQLCAFIRSLEDDPSQQANLLAEAKKLNDAQAPASSSSGSSSSGRASAGRERVYLPNLNADQLCAFIRSLE DDRSQSANLLAEAKKLNDAQAPK | 531 |
| ABPP521 | AGGETHYFPNLNADQLCAFIRSLEDDPSQQANLLAEAKKLNDAQAPASSSSGSSSSGRASAGRERVYLPNLNADQLCAFIRSLE DDPSQRANLLAEAKKLNDAQAPK | 532 |
| ABPP522 | AGGEQVYFRNLNADQLCAFIRSLEDDPSQQANLLAEAKKLNDAQAPASSSSGSSSSGRASAGRERVYLPNLNADQLCAFIRSLE DDPSQRANLLAEAKKLNDAQAPK | 533 |
| ABPP523 | AGGETVYFPNLNADQLCAFINAHQLCAFIRSLEDDPSQQANLLAEAKKLNDAQAPASSSSGSSSSGRASAGRERVYLPNLNADQLCAFIQSLE DDPSQRANLLAEAKKLNDAQAPK | 534 |
| ABPP524 | AGGETVYLPNLNADQLCAFIQSLEDDPSQQANLLAEAKKLNDAQAPASSSSGSSSSGRASAGRERVYLPNLNADQLCAFIQSLE DDRSQSANLLAEAKKLNDAQAPK | 535 |
| ABPP525 | AGGETVYLPNLNADQLCAFIQSLEDDPSQSANLLAEAKKLNDAQAPASSSSGSSSSGRASAGRERVYLPNLNAHQLCAFIRSLE DDPSQRANLLAEAKKLNDAQAPK | 536 |
| ABPP526 | AGGETVYFPNLNAHQLCAFIRSLEDDPSQQANLLAEAKKLNDAQAPASSSSGSSSSGRASAGRERVYLPNLNAHQLCAFIRSLE DDPSQRANLLAEAKKLNDAQAPK | 537 |
| ABPP527 | AGGEQVYFRNLNAHQLCAFIRSLEDDPSQQANLLAEAKKLNDAQAPASSSSGSSSSGRASAGRERVYLPNLNAHQLCAFIQSLE DDESQRANLLAEAKKLNDAQAPK | 538 |
| ABPP528 | AGGETVYLPNLNADQLCAFINSIEDDPSQQANLLAEAKKLNDAQAPASSSSGSSSSGRASAGRERVYLPNLNAHQLCAFIQSLE DDPSQSANLLAEAKKLNDAQAPK | 539 |
| ABPP529 | AGGETVYFPNLNADQLCAFIRSLEDDPSQQANLLAEAKKLNDAQAPASSSSGSSSSGRASAGRERVYLPNLNAHQLCAFIQSLE DDRSQSANLLAEAKKLNDAQAPK | 540 |
| ABPP530 | AGGETVYLPNLNADQLCAFIQSLEDDPSQQANLLAEAKKLNDAQAPASSSSGSSSSGRASAGRERVYLPNLNAHQLCAFIQSLE DDPSQRANLLAEAKKLNDAQAPK | 541 |
| ABPP531 | AGGETVYFPNLNADQLCAFIQSLEDDPSQQANLLAEAKKLNDAQAPASSSSGSSSSGRASAGRERVYLPNLNAHQLCAFIQSLE DDSSQRANLLAEAKKLNDAQAPK | 542 |
| ABPP532 | AGGETVYFPNLNADQLCAFIQSLEDDPSQSANLLAEAKKLNDAQAPASSSSGSSSSGRASAGRERVYLPNLNADQLCAFIQSLE DDPSQRANLLAEAKKLNDAQAPK | 543 |
| ABPP533 | AGGETVYLPNLNADQLCAFIQSLEDDPSQSANLLAEAKKLNDAQAPASSSSGSSSSGRASAGRERVYLPNLNADQLCAFIQSLE DDSSQRANLLAEAKKLNDAQAPK | 544 |
| ABPP534 | AGGETVYFPNLNADQLCAFIQSLEDDPSQSANLLAEAKKLNDAQAPASSSSGSSSSGRASAGRERVYLPNLNADQLCAFIQSLE DDRSQSANLLAEAKKLNDAQAPK | 545 |
| ABPP535 | AGGETVYLPNLNAHQLCAFIQSLEDDPSQQANLLAEAKKLNDAQAPASSSSGSSSSGRASAGRERVYLPNLNAHQLCAFIQSLE DDPSQSANLLAEAKKLNDAQAPK | 546 |
| ABPP536 | AGGETVYLPNLNADQLCAFIQSLEDDPSQQANLLAEAKKLNDAQAPASSSSGSSSSGRASAGRERVYLPNLNADQLCAFIQSLE DDPSQSANLLAEAKKLNDAQAPK | 547 |
| ABPP537 | AGGETVYLPNLNADQLCAFIQSLEDDPSQSANLLAEAKKLNDAQAPASSSSGSSSSGRASAGRERVYLPNLNADQLCAFIRSLE DDSSQRANLLAEAKKLNDAQAPK | 548 |
| ABPP538 | AGGEMVYLPNLNADQLCAFINSIEDDPSQSANLLAEAKKLNDAQAPASSSSGSSSSGRASAGRERVYLPNLNADQLCAFIRSLE DDSSQRANLLAEAKKLNDAQAPK | 549 |
| ABPP539 | AGGERVYLPNLNADQLCAFIRSLEDDPSQSANLLAEAKKLSEAQAPASSSSGSSSSGRASAGGERVYLPNLNADQLCAFIRSLE DDPSQRANLLAEAKKLNDAQAPK | 550 |
| ABPP095a | AGGERVYLPNLNADQLCAFIRSLEDDPSQSANLLAEAKKLSEAQAPK | 551 |

FIG. 1X

| NAME | SEQUENCE | SEQ ID NO: |
|---|---|---|
| ABPP095b | AGGERVYLPNLNADQLCAFIRSLEDDPSQSSELLSEAKKLSESQAPASSSSGSSSSGRASAGGERVYLPNLNADQLCAFIRSLE DDPSQSSELLSEAKKLSESQAPK | 552 |
| ABPP095c | AGGERVYLPNLTADQLCAFIRKLEDDPSQSSELLSEAKKLSESQAPASSSSGSSSSGRASAGGERVYLPNLTADQLCAFIRKLE DDPSQSSELLSEAKKLSESQAPK | 553 |

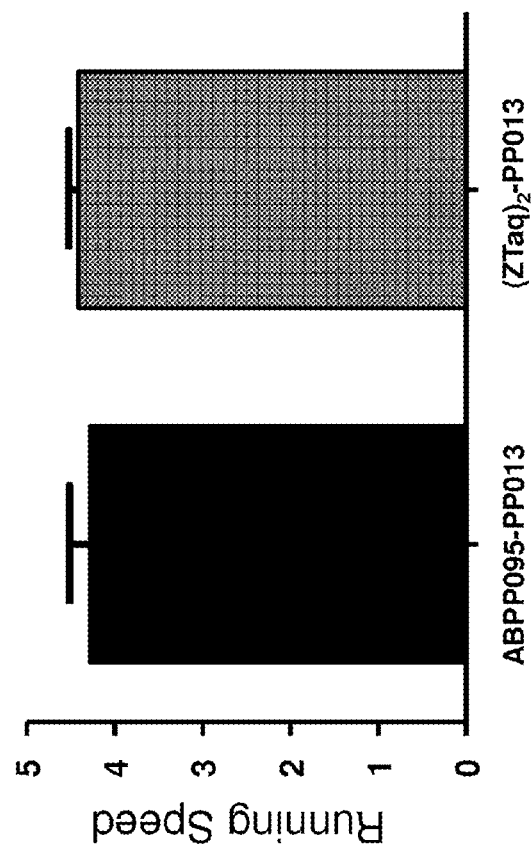

ALZHEIMER Aβ PEPTIDE BINDING POLYPEPTIDE

CROSS-REFERENCE TO RELATED APPLICATIONS

This Application is a continuation of Ser. No. 15/548,208, which is a U.S. National Stage Application of International Patent Application Serial No. PCT/EP2016/053665 filed Feb. 22, 2016 which claims priority to European Patent Application Serial No. 15185461.9, filed Sep. 16, 2015 and European Patent Application No. 15156018.2, filed Feb. 20, 2015, all of which are incorporated by reference in their entireties herein.

FIELD OF THE INVENTION

The present disclosure relates to a class of engineered polypeptides having a binding affinity for amyloid β (Aβ) peptide (in the following referred to as AR). The present disclosure also relates to the use of such AP peptide binding polypeptides as therapeutic, prognostic and/or diagnostic agents.

BACKGROUND

Many different diseases, such as Alzheimer's disease, type II diabetes, primary and secondary systemic amyloidosis, and familial amyloid polyneuropathy 1, have been recognized as belonging to the growing family of amyloid diseases. All amyloid diseases have in common the presence of extracellular protein aggregates that may or may not be fibrillar.

Alzheimer's disease (AD) is the leading cause of dementia worldwide, with approximately 35 million people affected. Current treatments for Alzheimer's disease provide only modest symptomatic relief, and there is a great need for therapies that slow the course of the disease and prevent or delay the disease in susceptible individuals. Despite tremendous research efforts during the last decades, there is currently no treatment that significantly alters the course of the disease or efficiently stops its development (Citron (2010) Nat Rev Drug Discov 9(5):387-398). The pathological hallmarks of AD include large extracellular amyloid plaques and intracellular neurofibrillary tangles in the brains of affected individuals (Citron (2010), supra). The main constituents of the amyloid plaques are the 40 and 42 amino acid amyloid beta (Aβ) peptides. It has been hypothesized that the aggregation process of these peptides into oligomers, protofibrils and fibrils play a pivotal role in the neuropathology of AD. Consequently, therapeutic strategies targeting the production and aggregation, as well as clearance of Aβ from the brain, are under investigation.

One promising approach for therapy is based on administration of Aβ-specific agents that bind directly to Aβ aggregates in the brain or to free Aβ peptides in the plasma (peripheral sink mechanism) (Citron (2010), supra). Conventional antibodies have demonstrated the great potential of immunotherapy, but have also been associated with severe side effects, such as Fc-mediated pro-inflammatory immune responses. Additionally, antibodies are large molecules and their size may have negative effect on in vivo biodistribution, including uptake into the brain. Therefore, alternative approaches using engineered antibody alternatives and alternative scaffold proteins without effector functions have been suggested to provide safer and more effective therapies, and smaller scaffold proteins are presumed to transfer across the blood-brain barrier faster than large antibodies.

Several molecules with affinity for specific targets and different non-antibody based scaffolds have been described in the art. In particular, molecules related to protein Z, derived from domain B of staphylococcal protein A (SPA) (Nilsson B et al (1987) Protein Engineering 1:107-133), have been selected from libraries of randomized protein Z molecules using different interaction targets (see eg WO95/19374; WO00/63243; Nord K et al (1995) Prot Eng 8:601-608; Nord K et al (1997) Nature Biotechnology 15:772-777).

A protein Z variant denoted $Z_{Aβ3}$, targeting monomeric Aβ with a 17 nM affinity (Grönwall et al (2007) J Biotechnol 128(1):162-183; Hoyer et al (2008) Proc Natl Acad Sci USA 105(13):5099-5104) has been described. Structural analysis has shown that $Z_{Aβ3}$ binds the Aβ peptide as a disulfide-linked homodimer (due to an internal cysteine), and that both the disulfide-linked dimeric Z variant and the Aβ peptide fold upon binding. The Aβ peptide folds into a β-hairpin structure, allowing the first α-helices in both Z variant units of the homodimer to adopt β-sheet structures with unstructured N-termini (Hoyer and Hard (2008) J. Mol. Biol. 378(2):398-411; Hoyer et al (2008), supra). In a recent in vivo study using an Aβ transgenic fruit fly model of AD, $Z_{Aβ3}$ was shown to efficiently inhibit formation of toxic amyloidogenic oligomers and plaques, thereby abolishing the neurotoxic effects and restoring the life span of the flies (Hoyer et al (2008), supra; Luheshi et al (2010) PLoS Biol 8(3):e1000334).

It has been demonstrated that there is a correlation between the affinity of peripherally administered Aβ specific agents and the efflux of Aβ from the brain to the plasma. Since levels of Aβ peptides in the blood are generally low, it is important to use capturing agents of high affinity for such applications.

Thus, there is a continued need for agents with a high affinity for Aβ, which can be used as reagents in various assays and processes where such an affinity is needed, such as treatment, diagnosis and prognosis of AD.

SUMMARY OF THE INVENTION

It is an object of the present disclosure to provide new Aβ peptide binding agents, which could for example be used for therapeutic, prognostic and diagnostic applications.

It is an object of the present disclosure to provide a molecule allowing for efficient therapy, targeting various forms of Aβ peptide related pathologies while alleviating the abovementioned and other drawbacks of current therapies.

It is furthermore an object of the present disclosure to provide a molecule suitable for prognostic and diagnostic applications.

These, and other objects which are evident to the skilled person from the present disclosure, are met by the different aspects of the invention as claimed in the appended claims and as generally disclosed herein.

Thus, in a first aspect of the disclosure, there is provided an Aβ peptide binding polypeptide, which comprises
a first moiety comprising a first Aβ peptide binding motif BM1,
a second moiety comprising a second Aβ peptide binding motif BM2, which motifs may be the same or different, and
a linker, wherein each one of said binding motifs BM1 and BM2 consists of an amino acid sequence selected from $$\text{i) } EX_2X_3YX_5X_6NLX_9A\ X_{11}QLCAX_{16}IX_{18}X_{19}X_{20}\ ED \quad \text{(SEQ ID NO: 632)}$$

wherein, independently from each other,
$X_2$ is selected from I, M, Q, R, T and Y;
$X_3$ is selected from H and V;
$X_5$ is selected from F, I and L;
$X_6$ is selected from P and T;
$X_9$ is selected from N and T;
$X_{11}$ is selected from D and H;
$X_{16}$ is selected from F and I;
$X_{18}$ is selected from N, Q and R;
$X_{19}$ is selected from K and S; and
$X_{20}$ is selected from F, I, L and R;
and
ii) an amino acid sequence which has at least 95% identity to the sequence defined in i).

The above definition of a class of sequence related, Aβ peptide binding polypeptides is based on a statistical analysis of a number of random polypeptide variants of a truncated dimer (($Z_{Aβ3A12}$)$_2$; SEQ ID NO:113) of the first generation Aβ peptide binding polypeptide $Z_{Aβ3}$. As detailed in the background section, this first generation Aβ peptide binding polypeptide was originally identified based on its interaction with Aβ peptide in selection experiments, and its binding surface has now been modified to create the variants defined herein. The identified Aβ peptide binding motifs (BM1 and BM2) correspond to the target binding region of the parent scaffold, which constitutes a 3 sheet and two a helices when bound to Aβ peptide.

As the skilled person will realize, the function of any polypeptide, such as the Aβ peptide binding capacity of the polypeptide of the present disclosure, is dependent on the tertiary structure of the polypeptide. It is therefore possible to make minor changes to the sequence of amino acids in a polypeptide without affecting the function thereof. Thus, the disclosure encompasses modified variants of the Aβ peptide binding polypeptide, which have retained Aβ peptide binding characteristics. In this way, encompassed by the present disclosure is an Aβ peptide binding polypeptide comprising an amino acid sequence with 95% or greater identity to a polypeptide as defined in i). For example, it is possible that an amino acid residue belonging to a certain functional group of amino acid residues (e.g. hydrophobic, hydrophilic, polar etc) could be exchanged for another amino acid residue from the same functional group.

In some embodiments, such changes may be made in any position of the sequence of the Aβ peptide binding polypeptide as disclosed herein. In other embodiments, such changes may be made only in the non-variable positions, also denoted scaffold amino acid residues. In such cases, changes are not allowed in the variable positions, i.e. positions denoted by an "X" in sequence i).

The term "% identity", as used throughout the specification, may for example be calculated as follows. The query sequence is aligned to the target sequence using the CLUSTAL W algorithm (Thompson et al (1994) Nucleic Acids Research, 22:4673-4680). A comparison is made over the window corresponding to the shortest of the aligned sequences. The shortest of the aligned sequences may in some instances be the target sequence. In other instances, the shortest of the aligned sequences may be the query sequence. The amino acid residues at each position are compared and the percentage of positions in the query sequence that have identical correspondences in the target sequence is reported as % identity.

In one embodiment of the first aspect, there is provided an Aβ peptide binding polypeptide, wherein, in sequence i) of said binding motifs,
$X_2$ is further selected from I, Q, and R;
$X_5$ is further selected from F and L;
$X_{16}$ is F; and
$X_{20}$ is further selected from I and L.

In one embodiment of the first aspect, there is provided an Aβ peptide binding polypeptide as defined above, wherein sequence i) in BM1 consists of the amino acid sequence $$\text{(SEQ ID NO: 558)}$$
$$EX_2X_3YX_5X_6NLX_9A\ X_{11}QLCAFIX_{18}X_{19}L\ ED$$

wherein, independently from each other,
$X_2$ is selected from I, M, Q, R and Y;
$X_3$ is selected from H and V;
$X_5$ is selected from F, I and L;
$X_6$ is selected from P and T;
$X_9$ is selected from N and T;
$X_{11}$ is selected from D and H;
$X_{18}$ is selected from N, Q and R; and
$X_{19}$ is selected from K and S.

In one embodiment, in sequence i) in BM1, $X_2$ is further selected from I and R; and $X_5$ is further selected from F and L.

In another embodiment, in sequence i) in BM1, $X_2$ is further selected from I, Q, R and Y; and $X_5$ is further selected from F and L.

In yet another embodiment, in sequence i) in BM1, $X_2$ is further selected from I and R; and $X_{18}$ is further selected from Q and R.

In still another embodiment, in sequence i) in BM1, $X_2$ is further selected from I, M and R.

In a further embodiment, in sequence i) in BM1, $X_2$ is further selected from I and R; $X_3$ is V; and $X_5$ is further selected from F and L.

In one embodiment, sequence i) in BM1 consists of the amino acid sequence $$\text{SEQ ID NO: 559}$$
$$EX_2VYX_5X_6NLNA\ X_{11}QLCAFIX_{18}SL\ ED$$

wherein, independently from each other,
$X_2$ is selected from I, M and R;
$X_5$ is selected from F, I and L;
$X_6$ is selected from P and T;
$X_{11}$ is selected from D and H; and
$X_{18}$ is selected from N, Q and R.

In one embodiment of the first aspect, there is provided an Aβ peptide binding polypeptide as defined above, wherein sequence i) in BM2 consists of the amino acid sequence $$\text{(SEQ ID NO: 560)}$$
$$EX_2VYX_5PNLX_9A\ X_{11}QLCAX_{16}IX_{18}X_{19}X_{20}\ ED$$

wherein, independently from each other,
$X_2$ is selected from I, M, Q, R and T;
$X_5$ is selected from F and L;
$X_9$ is selected from N and T;
$X_{11}$ is selected from D and H;
$X_{16}$ is selected from F and I;
$X_{18}$ is selected from N, Q and R;
$X_{19}$ is selected from K and S; and
$X_{20}$ is selected from F, I, L and R.

In one embodiment, in sequence i) in BM2, $X_2$ is further selected from I, Q and R; $X_{16}$ is F; and $X_{20}$ is further selected from I and L.

In another embodiment, in sequence i) in BM2, $X_2$ is further selected from R and T; and $X_5$ is L.

In yet another embodiment, in sequence i) in BM2, $X_2$ is R; $X_5$ is L; $X_{16}$ is F; and $X_{20}$ is further selected from I and L.

In still another embodiment, in sequence i) in BM2, $X_2$ is further selected from I, M, Q and R; $X_{16}$ is F; and $X_{20}$ is L.

In a further embodiment, in sequence i) in BM2, $X_2$ is further selected from I, Q and R; $X_{16}$ is F; and $X_{20}$ is L.

In one embodiment, sequence i) in BM2 consists of the amino acid sequence (SEQ ID NO: 561)
$EX_2VYX_5X_6NLNA$ $X_{11}QLCAFIX_{18}SX_{20}$ ED wherein, independently from each other,
$X_2$ is selected from I, M and R;
$X_5$ is selected from F, I and L;
$X_6$ is selected from P and T;
$X_{11}$ is selected from D and H;
$X_{18}$ is selected from N, Q and R; and
$X_{20}$ is selected from I and L.

In additional embodiments of any one of BM1 and BM2 as defined above, $X_6$ may instead be selected from P, T, R and Y.

As used herein, the designations "first binding motif" or "BM1" and "second binding motif" or "BM2", as well as the designations "first moiety" and "second moiety" are made for clarity reasons to distinguish between the Aβ peptide binding motifs and moieties. These designations are not intended to refer to the actual order of the different domains in the polypeptide. Thus, for example, said BM2 or second moiety may without restriction appear N-terminally or C-terminally of said BM1 or first moiety in the Aβ peptide binding polypeptide.

Herein, "$X_n$" and "$X_m$" are used to indicate amino acid residues in positions n and m in the sequence i) as defined above, wherein n and m are integers which indicate the position of an amino acid residue within said sequence as counted from the N-terminal end of said sequence. For example, $X_3$ and $X_6$ indicate the amino acid residue in positions three and six, respectively, from the N-terminal end of sequence i).

In the embodiments of the first aspect, polypeptides are provided wherein $X_n$ in sequence i) is independently selected from a group of possible residues according to Table 1. The skilled person will appreciate that $X_n$ may be selected from any one of the listed groups of possible residues and that this selection is independent from the selection of amino acid residues in $X_m$, wherein n≠m. Thus, any of the listed possible residues in position $X_n$ in Table 1 may be independently combined with any of the listed possible residues any other variable position in Table 1.

The skilled person will appreciate that Table 1 is to be read as follows: In one embodiment according to the first aspect, there is provided a polypeptide wherein amino acid residue "$X_n$" in sequence i) is selected from "Possible residues". Thus, Table 1 discloses several specific and individualized embodiments of the first aspect of the present disclosure. For example, in one embodiment according to the first aspect, there is provided a polypeptide wherein $X_2$ in sequence i) is selected from I, M, Q, R and Y, and in another embodiment according to the first aspect, there is provided a polypeptide wherein $X_2$ in sequence i) is selected from M, Q, R and T. For avoidance of doubt, the listed embodiments may be freely combined in yet other embodiments. For example, one such combined embodiment is a polypeptide in which $X_2$ is selected from I, M, Q, R and Y, while $X_6$ is T, and $X_{18}$ is selected from Q and R.

TABLE 1

| $X_n$ | Possible residues |
|---|---|
| $X_2$ | I, M, Q, R, Y |
| $X_2$ | M, Q, R, T |
| $X_2$ | I, Q, R, Y |
| $X_2$ | I, M, R |
| $X_2$ | T, R |
| $X_2$ | I, M, Q, R |
| $X_2$ | I, R, Y |
| $X_2$ | I, Q, R |
| $X_2$ | I, R |
| $X_2$ | R |
| $X_2$ | I |
| $X_3$ | V |
| $X_3$ | H |
| $X_5$ | F, L |
| $X_5$ | F, I |
| $X_5$ | I |
| $X_5$ | L |
| $X_5$ | F |
| $X_6$ | P |
| $X_6$ | T |
| $X_9$ | N |
| $X_9$ | T |
| $X_{11}$ | D |
| $X_{11}$ | H |
| $X_{16}$ | F |
| $X_{16}$ | I |
| $X_{18}$ | Q, R |
| $X_{18}$ | N, Q |
| $X_{18}$ | N, R |
| $X_{18}$ | Q |
| $X_{18}$ | N |
| $X_{18}$ | R |
| $X_{19}$ | K |
| $X_{19}$ | S |
| $X_{20}$ | I, L |
| $X_{20}$ | L |

In one embodiment of the first aspect, there is provided an Aβ peptide binding polypeptide, wherein at least one of said first and second moieties comprises the amino acid sequence $X_A GX_B$-[BM]

Wherein BM is BM1 or BM2 as defined herein, and, independently of each other,
$X_A$ is selected from A and S; and
$X_B$ is selected from G and R.

In another embodiment, there is provided an Aβ peptide binding polypeptide, wherein at least one of said first and second moieties comprises a binding module amino acid sequence, Bmod, selected from (SEQ ID NO: 562)
iii) [BM]-$DX_aSQX_bX_cX_dLLX_e$ $EAKKLX_fX_gX_hQA$ $PX_i$ wherein BM is BM1 or BM2 as defined above, and, independently of each other,
$X_a$ is selected from P, Q, R and S;
$X_b$ is selected from N, Q, R and S;
$X_c$ is selected from A and S;
$X_d$ is selected from K, N and E;
$X_e$ is selected from A, S and C;
$X_f$ is selected from E, N and S;

$X_g$ is selected from D, E and S;
$X_h$ is selected from A and S; and
$X_i$ is selected from no amino acid, A and K,
and iv) an amino acid sequence which has at least 97% identity to a sequence defined in iii).

In one embodiment, sequence iii) of Bmod consists of the amino acid sequence

[BM]-DX$_a$SQX$_b$AX$_d$LLA EAKKLNDAQA PX$_i$ (SEQ ID NO: 563)

wherein [BM] is [BM1] or [BM2] as defined above, and
$X_a$ is selected from P, Q, R and S;
$X_b$ is selected from N, Q, R and S;
$X_d$ is selected from K and N; and
$X_i$ is selected from no amino acid, A and K.

In one embodiment, sequence iii) consists of an amino acid sequence selected from:

[BM]-DPSQSANLLAEAKKLNDAQAP; (SEQ ID NO: 564)

[BM]-DPSQQANLLAEAKKLNDAQAP; (SEQ ID NO: 565)

[BM]-DSSQSANLLAEAKKLNDAQAP; (SEQ ID NO: 566)

[BM]-DPSQQAKLLAEAKKLNDAQAP; (SEQ ID NO: 567)

[BM]-DPSQNANLLAEAKKLNDAQAP; (SEQ ID NO: 568)

[BM]-DRSQQANLLAEAKKLNDAQAP; (SEQ ID NO: 569)

[BM]-DQSQRANLLAEAKKLNDAQAP; (SEQ ID NO: 570)

[BM]-DQSQQANLLAEAKKLNDAQAP; (SEQ ID NO: 571)

[BM]-DRSQSANLLAEAKKLNDAQAP; (SEQ ID NO: 572)

[BM]-DRSQRANLLAEAKKLNDAQAP; (SEQ ID NO: 573)
and

[BM]-DRSQNANLLAEAKKLNDAQAP. (SEQ ID NO: 574)

In a more specific embodiment, said first moiety comprises a Bmod in which sequence iii) is an amino acid sequence selected from

[BM1]-DPSQSANLLAEAKKLNDAQAPA; (SEQ ID NO: 575)

[BM1]-DPSQQANLLAEAKKLNDAQAPA; (SEQ ID NO: 576)

[BM1]-DSSQSANLLAEAKKLNDAQAPA; (SEQ ID NO: 577)

[BM1]-DPSQRANLLAEAKKLNDAQAPA; (SEQ ID NO: 578)

[BM1]-DPSQQAKLLAEAKKLNDAQAPA; (SEQ ID NO: 579)

[BM1]-DPSQNANLLAEAKKLNDAQAPA; (SEQ ID NO: 580)
and

[BM1]-DRSQNANLLAEAKKLNDAQAPA. (SEQ ID NO: 581)

In another specific embodiment, said second moiety comprises a Bmod in which sequence iii) is an amino acid sequence selected from

[BM2]-DPSQQANLLAEAKKLNDAQAPK; (SEQ ID NO: 582)

[BM2]-DPSQSANLLAEAKKLNDAQAPK; (SEQ ID NO: 583)

[BM2]-DRSQQANLLAEAKKLNDAQAPK; (SEQ ID NO: 584)

[BM2]-DQSQRANLLAEAKKLNDAQAPK; (SEQ ID NO: 585)

[BM2]-DQSQQANLLAEAKKLNDAQAPK; (SEQ ID NO: 586)

[BM2]-DPSQRANLLAEAKKLNDAQAPK; (SEQ ID NO: 587)

[BM2]-DRSQSANLLAEAKKLNDAQAPK; (SEQ ID NO: 588)

[BM2]-DRSQRANLLAEAKKLNDAQAPK; (SEQ ID NO: 589)

[BM2]-DSSQSANLLAEAKKLNDAQAPK; (SEQ ID NO: 590)
and

[BM2]-DPSQNANLLAEAKKLNDAQAPK. (SEQ ID NO: 591)

The first aspect of the disclosure also provides an Aβ peptide binding polypeptide as described above, wherein at least one of said first and second moieties comprises the amino acid sequence
$X_A GX_B$-[BMod]
wherein Bmod is as defined above, and, independently of each other,
$X_A$ is selected from A and S; and
$X_B$ is selected from G and R.

In one embodiment, at least one of said first and second moieties comprises an amino acid sequence selected from

AGG-[BM]DPSQSANLLAEAKKLNDAQAP; (SEQ ID NO: 592)

AGG-[BM]DPSQQANLLAEAKKLNDAQAP; (SEQ ID NO: 593)

AGG-[BM]DSSQSANLLAEAKKLNDAQAP; (SEQ ID NO: 594)

AGG-[BM]DPSQRANLLAEAKKLNDAQAP; (SEQ ID NO: 595)

AGR-[BM]DPSQSANLLAEAKKLNDAQAP; (SEQ ID NO: 596)

AGG-[BM]DPSQQAKLLAEAKKLNDAQAP; (SEQ ID NO: 597)

AGG-[BM]DPSQNANLLAEAKKLNDAQAP; (SEQ ID NO: 598)

```
                                      (SEQ ID NO: 599)
AGR-[BM]DPSQQANLLAEAKKLNDAQAP;

(SEQ ID NO: 600)
AGR-[BM]DRSQQANLLAEAKKLNDAQAP;

(SEQ ID NO: 601)
AGR-[BM]DQSQRANLLAEAKKLNDAQAP;

(SEQ ID NO: 602)
AGR-[BM]DQSQQANLLAEAKKLNDAQAP;

(SEQ ID NO: 603)
AGR-[BM]DPSQRANLLAEAKKLNDAQAP;

(SEQ ID NO: 604)
AGR-[BM]DRSQSANLLAEAKKLNDAQAP;

(SEQ ID NO: 605)
SGG-[BM]DPSQSANLLAEAKKLNDAQAP;

(SEQ ID NO: 606)
AGR-[BM]DRSQRANLLAEAKKLNDAQAP;

(SEQ ID NO: 607)
AGR-[BM]DPSQNANLLAEAKKLNDAQAP;

(SEQ ID NO: 608)
AGR-[BM]DSSQSANLLAEAKKLNDAQAP;
and (SEQ ID NO: 609)
AGR-[BM]DRSQNANLLAEAKKLNDAQAP.
```

In one embodiment, said first moiety comprises an amino acid sequence selected from

```
                                      (SEQ ID NO: 610)
AGG-[BM1]-DPSQSANLLAEAKKLNDAQAPA;

(SEQ ID NO: 611)
AGG-[BM1]-DPSQQANLLAEAKKLNDAQAPA;

(SEQ ID NO: 612)
AGG-[BM1]-DSSQSANLLAEAKKLNDAQAPA;

(SEQ ID NO: 613)
AGG-[BM1]-DPSQRANLLAEAKKLNDAQAPA;

(SEQ ID NO: 614)
AGR-[BM1]-DPSQSANLLAEAKKLNDAQAPA;

(SEQ ID NO: 615)
AGG-[BM1]-DPSQQAKLLAEAKKLNDAQAPA;
and (SEQ ID NO: 616)
AGG-[BM1]-DPSQNANLLAEAKKLNDAQAPA;

(SEQ ID NO: 617)
AGR-[BM1]-DPSQNANLLAEAKKLNDAQAP;

(SEQ ID NO: 618)
AGR-[BM1]-DSSQSANLLAEAKKLNDAQAP;
and (SEQ ID NO: 619)
AGR-[BM1]-DRSQNANLLAEAKKLNDAQAP.
```

In one embodiment, said second moiety comprises an amino acid sequence selected from

```
                                      (SEQ ID NO: 620)
AGR-[BM2]-DPSQQANLLAEAKKLNDAQAPK (SEQ ID NO: 621)
AGR-[BM2]-DPSQSANLLAEAKKLNDAQAPK;

(SEQ ID NO: 622)
AGR-[BM2]-DRSQQANLLAEAKKLNDAQAPK;

(SEQ ID NO: 623)
AGR-[BM2]-DQSQRANLLAEAKKLNDAQAPK;

(SEQ ID NO: 624)
AGR-[BM2]-DQSQQANLLAEAKKLNDAQAPK;

(SEQ ID NO: 625)
AGR-[BM2]-DPSQRANLLAEAKKLNDAQAPK;

(SEQ ID NO: 626)
AGR-[BM2]-DRSQSANLLAEAKKLNDAQAPK;

(SEQ ID NO: 627)
AGG-[BM2]-DPSQSANLLAEAKKLNDAQAPK;

(SEQ ID NO: 628)
SGG-[BM2]-DPSQSANLLAEAKKLNDAQAPK;

(SEQ ID NO: 629)
AGR-[BM2]-DRSQRANLLAEAKKLNDAQAPK;

(SEQ ID NO: 630)
AGG-[BM2]-DSSQSANLLAEAKKLNDAQAPK;
and (SEQ ID NO: 631)
AGG-[BM2]-DPSQNANLLAEAKKLNDAQAPK.
```

Similarly to the discussion above in relation to sequence i), "$X_y$" and "$X_z$" are used herein to indicate amino acid residues in positions y and z in the sequences defined above, wherein y and z represent letters A, B and a-i which indicate the position of variable amino acid residues within said sequence counted from the N-terminal end of said sequence. For example, $X_a$ and $X_b$ indicate the first and second variable amino acid residue, respectively, counted from the N-terminal end of sequence iii), but do not have to be in positions one and two in the amino acid sequence.

In embodiments according to the first aspect, there are provided polypeptides wherein the variable amino acid residues $X_y$ are independently selected from a group of possible residues according to Table 2. The skilled person will appreciate that $X_y$ may be selected from any one of the listed groups of possible residues and that this selection is independent from the selection of amino acids in $X_z$, wherein y z. Thus, any of the listed possible residues in position $X_y$ in Table 2 may be independently combined with any of the listed possible residues in any other variable position in Table 2.

The skilled person will appreciate that Table 2 is to be read as follows: In one embodiment according to the first aspect, there is provided a polypeptide wherein amino acid residue "$X_y$" is selected from "Possible residues". Thus, Table 2 discloses several specific and individualized embodiments of the first aspect of the present disclosure.

TABLE 2

| $X_y$ | Possible residues |
|---|---|
| $X_A$ | A |
| $X_A$ | S |
| $X_B$ | G |
| $X_B$ | R |
| $X_a$ | P, Q, R |
| $X_a$ | P, R, S |
| $X_a$ | P, R |
| $X_a$ | P, Q |
| $X_a$ | P, S |

TABLE 2-continued

| $X_y$ | Possible residues |
|---|---|
| $X_a$ | P |
| $X_a$ | R |
| $X_a$ | S |
| $X_a$ | Q |
| $X_b$ | Q, R, S |
| $X_b$ | N, R, S |
| $X_b$ | R, S |
| $X_b$ | R, Q |
| $X_b$ | Q, S |
| $X_b$ | N, S |
| $X_b$ | N |
| $X_b$ | Q |
| $X_b$ | R |
| $X_b$ | S |
| $X_c$ | A |
| $X_c$ | S |
| $X_d$ | N |
| $X_d$ | K |
| $X_d$ | E |
| $X_e$ | A |
| $X_e$ | S |
| $X_e$ | C |
| $X_f$ | E |
| $X_f$ | N |
| $X_f$ | S |
| $X_g$ | D |
| $X_g$ | E |
| $X_g$ | S |
| $X_h$ | A |
| $X_h$ | S |
| $X_i$ | A |
| $X_i$ | K |
| $X_i$ | no amino acid |

Additionally, Table 3 lists possible combinations of 2, 3 or 6 of $X_{A-B}$ and $X_{a-i}$. The skilled person will appreciate that these combinations may be independently combined with any of the listed possible residues in any other variable position in Table 2.

TABLE 3

| $X_y$ | Possible residues |
|---|---|
| $X_A$, $X_B$ | A, G; A, R |
| $X_A$, $X_B$ | A, G |
| $X_A$, $X_B$ | A, R |
| $X_f$, $X_g$ | E, E; E, S; S, D; S, E; S, S; N, D |
| $X_f$, $X_g$ | E, S |
| $X_f$, $X_g$ | S, E |
| $X_f$, $X_g$ | S, D |
| $X_f$, $X_g$ | N, D |
| $X_a$, $X_b$, $X_d$ | P, Q, N; P, S, N; P, Q, K; Q, R, N; S, S, N |
| $X_a$, $X_b$, $X_d$ | P, Q, N; P, S, N; Q, R, N |
| $X_a$, $X_b$, $X_d$ | P, Q, N; P, S, N |
| $X_a$, $X_b$, $X_d$ | P, S, N |
| $X_a$, $X_b$, $X_d$ | P, Q, N |
| $X_a$, $X_b$, $X_d$ | Q, R, N |
| $X_a$, $X_b$, $X_d$ | P, Q, K |
| $X_a$, $X_b$, $X_d$ | S, S, N |
| $X_A$, $X_B$, $X_a$, $X_b$, $X_d$, $X_i$ | A, G, P, Q, N, A; A, G, P, S, N, A; A, R, P, S, N, A; A, G, P, Q, K, A; A, R, Q, R, N, K; A, R, P, S, N, K; ARPQNK; A, G, P, S, N, K; A, R, S, S, N, A; A, G, S, S, N, K |

TABLE 3-continued

| $X_y$ | Possible residues |
|---|---|
| $X_A$, $X_B$, $X_a$, $X_b$, $X_d$, $X_i$ | A, G, P, Q, N, A; A, R, P, S, N, A; A, G, P, S, N, A; A, R, Q, R, N, K; A, G, P, S, N, K |
| $X_A$, $X_B$, $X_a$, $X_b$, $X_d$, $X_i$ | A, G, P, Q, N, A; A, R, Q, P, K, K |
| $X_A$, $X_B$, $X_a$, $X_b$, $X_d$, $X_i$ | A, G, P, Q, N, A |
| $X_A$, $X_B$, $X_a$, $X_b$, $X_d$, $X_i$ | A, G, P, S, N, A |
| $X_A$, $X_B$, $X_a$, $X_b$, $X_d$, $X_i$ | A, R, P, S, N, A |
| $X_A$, $X_B$, $X_a$, $X_b$, $X_d$, $X_i$ | A, G, P, Q, K, A |
| $X_A$, $X_B$, $X_a$, $X_b$, $X_d$, $X_i$ | A, R, Q, R, N, K |
| $X_A$, $X_B$, $X_a$, $X_b$, $X_d$, $X_i$ | A, R, P, S, N, K |
| $X_A$, $X_B$, $X_a$, $X_b$, $X_d$, $X_i$ | A, R, P, Q, N, K |
| $X_A$, $X_B$, $X_a$, $X_b$, $X_d$, $X_i$ | A, G, P, S, N, K |
| $X_c$, $X_d$, $X_e$, $X_f$, $X_g$, $X_h$ | A, N, A, N, D, A |
| $X_c$, $X_d$, $X_e$, $X_f$, $X_g$, $X_h$ | A, N, A, S, E, A |
| $X_c$, $X_d$, $X_e$, $X_f$, $X_g$, $X_h$ | A, N, A, S, D, A |
| $X_c$, $X_d$, $X_e$, $X_f$, $X_g$, $X_h$ | S, E, S, N, D, S |
| $X_c$, $X_d$, $X_e$, $X_f$, $X_g$, $X_h$ | S, E, S, S, E, S |
| $X_c$, $X_d$, $X_e$, $X_f$, $X_g$, $X_h$ | S, E, S, S, D, S |
| $X_c$, $X_d$, $X_e$, $X_f$, $X_g$, $X_h$ | S, E, C, N, D, S |
| $X_c$, $X_d$, $X_e$, $X_f$, $X_g$, $X_h$ | S, E, C, S, E, S |
| $X_c$, $X_d$, $X_e$, $X_f$, $X_g$, $X_h$ | S, E, C, S, D, S |

As discussed above, polypeptides comprising minor changes as compared to the above amino acid sequences, which changes do not largely affect the tertiary structure or function of the polypeptide, are also within the scope of the present disclosure. Thus, sequence iv) has at least 97% identity to a sequence defined by iii).

In one embodiment of the Aβ peptide binding polypeptide according to the first aspect of the disclosure, the definitions above are subject to the proviso that at least one of the first and second moiety of the polypeptide does not comprise an amino acid sequence selected from

```
                                           (SEQ ID NO: 554)
VDNKFNKEGK GAPGEIHYLP NLNADQLCAF IRSLEDDPSQ

SANLLAEAKK LNDAQAPK
and
                                           (SEQ ID NO: 555)
VDNKFNKEIE VATGEIVYLP NLNADQLCAF INSLEDDPSQ

SANLLAEAKK LNDAQAPK.
```

As stated above, the Aβ peptide binding polypeptide according to the first aspect comprises a linker. In one embodiment, said linker is arranged between said first moiety and said second moiety as defined herein.

The skilled person is aware of different kinds of linkers with different properties, such as flexible amino acid linkers, rigid amino acid linkers and cleavable amino acid linkers. Linkers have been used to for example increase stability or improve folding of fusion proteins, to increase expression, improve biological activity, enable targeting and alter pharmacokinetics of fusion proteins.

Flexible linkers are often used when the joined domains require a certain degree of movement or interaction, and may be particularly useful in some embodiments of the Aβ peptide binding polypeptide as defined herein. Such linkers are generally composed of small, non-polar (for example G) or polar (for example S or T) amino acids. Some flexible linkers primarily consist of stretches of G and S residues, for example (GGGGS (SEQ ID NO:648))$_p$ and (SSSSG (SEQ ID NO:649))$_p$. Adjusting the copy number "p" allows for optimization of the linker in order to achieve appropriate separation between the functional moieties or to maintain necessary inter-moiety interaction. Apart from G and S linkers, other flexible linkers are known in the art, such as G and S linkers containing additional amino acid residues, such as T, A, K and E, to maintain flexibility, as well as polar amino acid residues to improve solubility.

In one embodiment of the first aspect disclosed herein, the linker is a flexible linker comprising at least one amino acid residue selected from the group consisting of glycine (G), serine (S) and threonine (T). In one embodiment, said linker has a general formula selected from $(G_nS_m)_p$ and $(S_nG_m)_p$, wherein, independently, n=1-7, m=0-7, n+m<8 and p=1-10. In one embodiment, n=1-5. In one embodiment, m=0-5. In one embodiment, p=1-5. In one embodiment, said linker is selected from the group consisting of $S_4G$ (SEQ ID NO:649), $(S_4G)_3$ (SEQ ID NO:634), $(S_4G)_4$ (SEQ ID NO:650) and $(S_4G)_8$ (SEQ ID NO:651). In one embodiment, said linker is selected from the group consisting of $S_4G$ (SEQ ID NO:649), $(S_4G)_2$ (SEQ ID NO:633), $(S_4G)_3$ (SEQ ID NO:634) and $(S_4G)_4$ (SEQ ID NO:650). In a more specific embodiment, n=4, m=1 and p=2-3. In one embodiment, said linker is selected from the group consisting of $(S_4G)_2$ (SEQ ID NO:633) and $(S_4G)_3$ (SEQ ID NO:634). In one embodiment, said linker is $(S_4G)_2$ (SEQ ID NO:633). In one embodiment, said linker is $(S_4G)_3$ (SEQ ID NO:634).

In another embodiment of the first aspect of the present disclosure, there is provided an Aβ peptide binding polypeptide as defined herein, in which said linker comprises an amino acid sequence selected from the group consisting of VEVDNKFNKEMAS, VDNKFNKEMAS, VEVDNKFNKE, VDNKFNKE, AEAKYAKE, ADNNFNK, ADNKFNK, ADAQQNNFNK, AQHDE, VDNKFNK, AEAKYAK, VDAKYAK and ADAKYAK. In one embodiment, said sequence is selected from VEVDNKFNKEMAS and VDNKFNKEMAS. In one embodiment, said sequence is selected from VEVDNKFNKE and VDNKFNKE. In one embodiment, said sequence is VEVDNKFNKEMAS. In another embodiment, said sequence is VEVDNKFNKE.

The skilled person will appreciate that the properties of the linker will generally not be changed by the addition of a small number of amino acid residues to its N- or C-terminus. Thus, in a further embodiment, said linker further comprises 1-5 additional amino acid residues at the N- or C-terminal end of said linker, such as 1-4 additional amino acid residues, such as 1-3 additional amino acid residues, such as 3 additional amino acid residues. In one embodiment, said additional amino acid residues are selected from the group consisting of AS, MAS and RAS. In one embodiment, said additional amino acid residues are RAS. In one embodiment, said additional amino acid residues are MAS.

The skilled person will appreciate that the presence of a linker arranged in any of the contexts mentioned above does not exclude the presence of additional linkers in the same or any other context. Thus, in one embodiment, the Aβ peptide binding polypeptide as defined herein further comprises at least one additional linker, such as a linker selected from the group consisting of flexible amino acid linkers, rigid amino acid linkers and cleavable amino acid linkers. In one embodiment, said linker is arranged between the Aβ peptide binding polypeptide as disclosed herein and a second or further part consisting of a polypeptide having a desired biological activity. Further below is a general discussion of alternatives for such a second part.

The skilled person will appreciate that the Aβ peptide binding polypeptides as disclosed herein may comprise any first moiety in combination with any second moiety. Thus, the presence of one particular first moiety as disclosed herein does neither limit the choice of second moiety nor the choice of linker as disclosed herein, and vice versa. The skilled person will appreciate that first moiety, second moiety and linker as disclosed herein may be independently combined.

As described in detail in the experimental section to follow, the selection of Aβ peptide binding polypeptides led to the identification of a number of individual Aβ peptide binding motifs (BM1 and BM2). These motifs constitute individual embodiments of sequence i) according to this aspect. The Aβ peptide binding motifs BM1 and BM2 of the Aβ peptide correspond to amino acid residues 4-25 and 64-85, respectively, in the sequences with SEQ ID NO:1-17, 19-106 and 118-553, and to amino acid residues 4-25 and 69-90, respectively, in SEQ ID NO:18, all as presented in FIG. 1A-X. Hence, in one embodiment of the Aβ peptide binding polypeptide as defined herein, sequence i) of BM1 corresponds to amino acid residues 4-25 in any one of SEQ ID NO:1-106 and 118-553, while sequence i) of BM2 corresponds to amino acid residues 64-85 in any one of SEQ ID NO:1-17, 19-106 and 118-553 or to amino acid residues 69-90 in SEQ ID NO:18. In another embodiment, sequence i) of BM1 corresponds to amino acid residues 4-25 in any one of SEQ ID NO:1-106, while sequence i) of BM2 corresponds to amino acid residues 64-85 in any one of SEQ ID NO:1-17 and 19-106 or to amino acid residues 69-90 in SEQ ID NO:18. In another embodiment, sequence i) of BM1 corresponds to amino acid residues 4-25 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159, while sequence i) of BM2 corresponds to amino acid residues 64-85 in any one of SEQ ID NO:1, 5, 9, 13, 14, 16, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 or to amino acid residues 69-90 in SEQ ID NO:18. In another embodiment, sequence i) of BM1 corresponds to amino acid residues 4-25 in any one of SEQ ID NO:1, 5, 9, 13, 14, 16, 18, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104, while sequence i) of BM2 corresponds to amino acid residues 64-85 in any one of SEQ ID NO:1, 5, 9, 13, 14, 16, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104 or to amino acid residues 69-90 in SEQ ID NO:18. In another embodiment, sequence i) of BM1 corresponds to amino acid residues 4-25 in any one of SEQ ID NO:18, 28, 35, 49, 50, 51, 55, 59, 64, 65, 70, 72, 78, 84, 95 and 118-159, while sequence i) of BM2 corresponds to amino acid residues 64-85 in any one of SEQ ID NO:28, 35, 49, 50, 51, 55, 59, 64, 65, 70, 72, 78, 84, 95 and 118-159 or to amino acid residues 69-90 in SEQ ID NO:18. In another embodiment, sequence i) of BM1 corresponds to amino acid residues 4-25 in any one of SEQ ID NO:18, 51, 55, 59, 64, 70, 78, 95 and 118-142, while sequence i) of BM2 corresponds to amino acid residues 64-85 in any one of SEQ ID NO:51, 55, 59, 64, 70, 78, 95 and 118-142 or to amino acid residues 69-90 in SEQ ID NO:18. In another embodiment, sequence i) of BM1 corresponds to amino acid residues 4-25 in any one of SEQ ID NO:18, 55, 70, 95, 124-127, 130-133, 139 and 140, while sequence i) of BM2 corresponds to amino acid residues 64-85 in any one of SEQ ID NO:55, 70, 95, 124-127, 130-133, 139 and 140 or to amino acid residues 69-90 in SEQ ID NO:18. In another embodiment, sequence i) of BM1 corresponds to amino acid residues 4-25 in any one of SEQ ID NO:18, 55, 70, 95, 124, 125, 132, 133, 139 and 140, while sequence i) of BM2 corresponds to amino acid residues 64-85 in any one of SEQ ID NO:55, 70, 95, 124, 125, 132, 133, 139 and 140 or to amino acid residues 69-90 in SEQ ID NO:18. In another embodiment, sequence i) of BM1 corresponds to amino acid residues 4-25 in any one of SEQ ID NO:18, 28, 35, 49, 50, 70, 84 and 95, while sequence i) of BM2 corresponds to amino acid residues 64-85 in any one of SEQ ID NO:28, 35, 49, 50, 70, 84 and 95 or to amino acid residues 69-90 in SEQ ID NO:18. In one embodiment, sequence i) of BM1 corresponds to amino acid residues 4-25 in any one of SEQ ID NO:18, 70 and 95, while sequence i) of BM2 corresponds to amino acid residues 64-85 in any one of SEQ ID NO:70 and 95 or amino acid residues 69-90 in SEQ ID NO:18. In one particular embodiment, sequence i) of BM1 corresponds to amino acid residues 4-25 in SEQ ID NO:95 and sequence i) of BM2 corresponds to amino acid residues 64-85 in SEQ ID NO:95.

In another embodiment, there is provided an Aβ peptide binding polypeptide as disclosed herein, wherein the first moiety comprises amino acid residues 1-25 in any one of SEQ ID NO:1-106 and 118-553 and the second moiety comprises amino acid residues 61-85 in any one of SEQ ID NO:1-17, 19-106 and 118-553 or amino acid residues 66-90 in SEQ ID NO:18. In another embodiment, there is provided an Aβ peptide binding polypeptide as disclosed herein, wherein the first moiety comprises amino acid residues 1-25 in any one of SEQ ID NO:1-106 and the second moiety comprises amino acid residues 61-85 in any one of SEQ ID NO:1-17 and 19-106 or amino acid residues 66-90 in SEQ ID NO:18. In another embodiment, the first moiety comprises amino acid residues 1-25 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 and the second moiety comprises amino acid residues 61-85 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 or amino acid residues 66-90 in SEQ ID NO:18. In another embodiment, the first moiety comprises amino acid residues 1-25 in any one of SEQ ID NO:1, 5, 9, 13, 14, 16, 18, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104 and the second moiety comprises amino acid residues 61-85 in any one of SEQ ID NO:1, 5, 9, 13, 14, 16, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104 or amino acid residues 66-90 in SEQ ID NO:18. In another embodiment, the first moiety comprises amino acid residues 1-25 in any one of SEQ ID NO:18, 28, 35, 49, 50, 51, 55, 59, 64, 65, 70, 72, 78, 84, 95 and 118-159 and the second moiety comprises amino acid residues 61-85 in any one of SEQ ID NO:28, 35, 49, 50, 51, 55, 59, 64, 65, 70, 72, 78, 84, 95 and 118-159 or amino acid residues 66-90 in SEQ ID NO:18. In another embodiment, the first moiety comprises amino acid residues 1-25 in any one of SEQ ID NO:18, 51, 55, 59, 64, 70, 78, 95 and 118-142 and the second moiety comprises amino acid residues 61-85 in any one of SEQ ID NO:51, 55, 59, 64, 70, 78, 95 and 118-142 or amino acid residues 66-90 in SEQ ID NO:18. In another embodiment, the first moiety comprises amino acid residues 1-25 in any one of SEQ ID NO:18, 55, 70, 95, 124-127, 130-133, 139 and 140 and the second moiety comprises amino acid residues 61-85 in any one of SEQ ID NO:55, 70, 95, 124-127, 130-133, 139 and 140 or amino acid residues 66-90 in SEQ ID NO:18. In another embodiment, the first moiety comprises amino acid residues 1-25 in any one of SEQ ID NO:18, 55, 70, 95, 124, 125, 132, 133, 139 and 140 and the second moiety comprises amino acid residues 61-85 in any one of SEQ ID NO:55, 70, 95, 124, 125, 132, 133, 139 and 140 or amino acid residues 66-90 in SEQ ID NO:18. In yet another embodiment, the first moiety comprises amino acid residues 1-25 in any one of SEQ ID NO:18, 28, 35, 49, 50, 70, 84 and 95 and the second moiety comprises amino acid residues 61-85 in any one of SEQ ID NO:28, 35, 49, 50, 70, 84 and 95 or amino acid residues 66-90 in SEQ ID NO:18. In one embodiment, the first moiety comprises amino acid residues 1-25 in any one of SEQ ID NO:18, 70 and 95 and the second moiety comprises amino acid residues 61-85 in any one of SEQ ID NO:70 and 95 or amino acid residues 66-90 in SEQ ID NO:18. In one particular embodiment, the first moiety comprises amino acid residues 1-25 in SEQ ID NO:95 and the second moiety comprises amino acid residues 61-85 in SEQ ID NO:95.

In another embodiment, there is provided an Aβ peptide binding polypeptide as disclosed herein having a binding module, Bmod, as defined above, wherein sequence iii) in Bmod of the first moiety corresponds to amino acid residues 4-47 in any one of SEQ ID NO:1-106 and 118-553, while sequence iii) in Bmod of the second moiety comprises amino acid residues 64-107 in any one of SEQ ID NO:1-17, 19-106 and 118-553 or amino acid residues 69-112 in SEQ ID NO:18. In another embodiment, sequence iii) in Bmod of the first moiety corresponds to amino acid residues 4-47 in any one of SEQ ID NO:1-106, while sequence iii) in Bmod of the second moiety comprises amino acid residues 64-107 in any one of SEQ ID NO:1-17 and 19-106 or amino acid residues 69-112 in SEQ ID NO:18. In another embodiment, sequence iii) in Bmod of the first moiety corresponds to amino acid residues 4-47 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159, while sequence iii) in Bmod of the second moiety comprises amino acid residues 64-107 in any one of SEQ ID NO:1, 5, 9, 13, 14, 16, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 or amino acid residues 69-112 in SEQ ID NO:18. In another embodiment, sequence iii) in Bmod of the first moiety corresponds to amino acid residues 4-47 in any one of SEQ ID NO:1, 5, 9, 13, 14, 16, 18, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104, while sequence iii) in Bmod of the second moiety comprises amino acid residues 64-107 in any one of SEQ ID NO:1, 5, 9, 13, 14, 16, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104 or amino acid residues 69-112 in SEQ ID NO:18. In another embodiment, sequence iii) in Bmod of the first moiety corresponds to amino acid residues 4-47 in any one of SEQ ID NO:18, 28, 35, 49, 50, 51, 55, 59, 64, 65, 70, 72, 78, 84, 95 and 118-159, while sequence iii) in Bmod of the second moiety comprises amino acid residues 64-107 in any one of SEQ ID NO:28, 35, 49, 50, 51, 55, 59, 64, 65, 70, 72, 78, 84, 95 and 118-159 or amino acid residues 69-112 in SEQ ID NO:18. In another embodiment, sequence iii) in Bmod of the first moiety corresponds to amino acid residues 4-47 in any one of SEQ ID NO:18, 51, 55, 59, 64, 70, 78, 95 and 118-142, while sequence iii) in Bmod of the second moiety comprises amino acid residues 64-107 in any one of SEQ ID NO:51, 55, 59, 64, 70, 78, 95 and 118-142 or amino acid residues 69-112 in SEQ ID NO:18. In another embodiment, sequence iii) in Bmod of the first moiety corresponds to amino acid residues 4-47 in any one of SEQ ID NO:18, 55, 70, 95, 124-127, 130-133, 139 and 140, while sequence iii) in Bmod of the second moiety comprises amino acid residues 64-107 in any one of SEQ ID NO:55, 70, 95, 124-127, 130-133, 139 and 140 or amino acid residues 69-112 in SEQ ID NO: 18. In another embodiment, sequence iii) in Bmod of the first moiety corresponds to amino acid residues 4-47 in any one of SEQ ID NO:18, 55, 70, 95, 124, 125, 132, 133, 139 and 140, while sequence iii) in Bmod of the second moiety comprises amino acid residues 64-107 in any one of SEQ ID NO:55, 70, 95, 124, 125, 132, 133, 139 and 140 or amino acid residues 69-112 in SEQ ID NO:18. In yet another embodiment, sequence iii) in Bmod of the first moiety corresponds to amino acid residues 4-47 in any one of SEQ ID NO:18, 28, 35, 49, 50, 70, 84 and 95, while sequence iii) in Bmod of the second moiety comprises amino acid residues 64-107 in any one of SEQ ID NO:28, 35, 49, 50, 70, 84 and 95 or amino acid residues 69-112 in SEQ ID NO:18. In one embodiment, sequence iii) in Bmod of the first moiety corresponds to amino acid residues 4-47 in any one of SEQ ID NO:18, 70 and 95, while sequence iii) in Bmod of the second moiety comprises amino acid residues 64-107 in any one of SEQ ID NO:70 and 95 or amino acid residues 69-112 in SEQ ID NO:18. In one particular embodiment, sequence iii) in Bmod of the first moiety corresponds to amino acid residues 4-47 in SEQ ID NO:95 and sequence iii) in Bmod of the second moiety comprises amino acid residues 64-107 in SEQ ID NO:95.

As discussed above, the skilled person will appreciate that the 22 amino acid residue binding motifs, BM, as well as the various stretches of 25, 44 or 47 amino acid residues as defined herein and all comprising a BM, may all be combined independently. For example, the BM or a 25 amino acid residue stretch comprising a BM, may be grafted into another amino acid environment than that of the original polypeptide, which new environment substantially retains the three-dimensional structure of the original environment. Thus, in another embodiment of the Aβ peptide binding polypeptide as disclosed herein, there is provided a Aβ peptide binding polypeptide wherein the first moiety comprises an amino acid sequence corresponding to amino acid residues 4-25, 1-25, 4-47 or 1-47 from any one of SEQ ID NO:1-106 and 118-553; and the second moiety comprises an amino acid sequence corresponding to amino acid residues 64-85, 61-85, 64-107 or 61-107 from any one of SEQ ID NO:1-17, 19-106 and 118-553 or to amino acid residues 69-90, 66-90, 69-112 or 66-112 from SEQ ID NO:18, and wherein both amino acid sequences comprised in each of the first and second moieties are from the same SEQ ID NO. Also, in another embodiment of the Aβ peptide binding polypeptide as disclosed herein, there is provided a Aβ peptide binding polypeptide wherein the first moiety comprises an amino acid sequence corresponding to amino acid residues 4-25, 1-25, 4-47 or 1-47 from any one of SEQ ID NO:1-106; and the second moiety comprises an amino acid sequence corresponding to amino acid residues 64-85, 61-85, 64-107 or 61-107 from any one of SEQ ID NO:1-17 and 19 to 106; or to amino acid residues 69-90, 66-90, 69-112 or 66-112 from SEQ ID NO:18, and wherein both amino acid sequences comprised in each of the first and second moieties are from the same SEQ ID NO.

In another embodiment according to this aspect of the disclosure, there is provided an Aβ peptide binding polypeptide, which comprises an amino acid sequence selected from the group consisting of SEQ ID NO:1-106 and 118-553; such as from the group consisting of SEQ ID NO:1-106; such as from the group consisting of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159; such as from the group consisting of SEQ ID NO:1, 5, 9, 13, 14, 16, 18, 20, 21, 25, 26, 28, 33, 35, 37, 40, 42, 48, 49, 50, 53, 54, 59, 60, 61, 62, 70, 75, 78, 84, 89, 90, 95, 96, 97, 100 and 104; such as from the group consisting of SEQ ID NO:18, 28, 35, 49, 50, 51, 55, 59, 64, 65, 70, 72, 78, 84, 95 and 118-159; such as from the group consisting of SEQ ID NO:18, 51, 55, 59, 64, 70, 78, 95 and 118-142; such as from the group consisting of SEQ ID NO:18, 55, 70, 95, 124-127, 130-133, 139 and 140; such as from the group consisting of SEQ ID NO:18, 55, 70, 95, 124, 125, 132, 133, 139 and 140; such as from the group consisting of SEQ ID NO:18, 28, 35, 49, 50, 70, 84 and 95; such as from the group consisting of SEQ ID NO 18, 70 and 95. In one embodiment, the Aβ peptide binding polypeptide comprises SEQ ID NO:95.

"Amyloid β", "Aβ" or "β-amyloid" as used herein refer to amyloid β proteins and peptides, amyloid β precursor protein (APP), as well as modifications, fragments and functional equivalents thereof. In particular, by "amyloid β peptide" or "Aβ peptide" is meant any fragment produced by proteolytic cleavage of APP, especially fragments which are involved in or associated with the amyloid pathologies. Such fragments include, but are not limited to, $A\beta_{1-38}$, $A\beta_{1-39}$, $A\beta_{1-40}$, $A\beta_{1-41}$, $A\beta_{1-42}$ and $A\beta_{1-43}$.

The terms "Aβ peptide binding" and "binding affinity for Aβ peptide" as used in this specification refer to a property of a polypeptide which may be tested for example by ELISA or by use of surface plasmon resonance (SPR) technology.

For example as described in the examples below, Aβ peptide binding affinity may be tested in an experiment in which samples of the polypeptide are captured on antibody coated ELISA plates and biotinylated Aβ peptide is added, followed by streptavidin conjugated HRP. TMB substrate is added and the absorbance at 450 nm is measured using a multi-well plate reader, such as Victor$^3$ (Perkin Elmer). The skilled person may then interpret the results obtained by such experiments to establish at least a qualitative measure of the binding affinity of the polypeptide for Aβ peptide. If a quantitative measure is desired, for example to determine the EC50 value (the half maximal effective concentration) for the interaction, ELISA may also be used. The response of the polypeptides against a dilution series of biotinylated Aβ peptide is measured using ELISA as described above. The skilled person may then interpret the results obtained by such experiments and EC50 values may be calculated from the results using for example GraphPad Prism 5 and non-linear regression.

Aβ peptide binding affinity may also be tested in an experiment in which Aβ peptide, or a fragment thereof, is immobilized on a sensor chip of a surface plasmon resonance (SPR) instrument, and the sample containing the polypeptide to be tested is passed over the chip. Alternatively, the polypeptide to be tested is immobilized on a sensor chip of the instrument, and a sample containing Aβ peptide, or a fragment thereof, is passed over the chip. The skilled person may then interpret the results obtained by such experiments to establish at least a qualitative measure of the binding affinity of the polypeptide for Aβ peptide. If a quantitative measure is desired, for example to determine a $K_D$ value for the interaction, surface plasmon resonance methods may also be used. Binding values may for example be defined in a Biacore (GE Healthcare) or ProteOn XPR 36 (Bio-Rad) instrument. Aβ peptide is suitably immobilized on a sensor chip of the instrument, and samples of the polypeptide whose affinity is to be determined are prepared by serial dilution and injected in random order. $K_D$ values may then be calculated from the results using for example the 1:1 Langmuir binding model of the BIAevaluation 4.1 software, or other suitable software, provided by the instrument manufacturer.

In one embodiment, the Aβ peptide binding polypeptide is capable of binding to Aβ peptide such that the EC50 value of the interaction is at most $1\times10^{-7}$ M, such as at most $1\times10^{-8}$ M, such as at most $1\times10^{-9}$ M, such as at most $1\times10^{-10}$ M.

In one embodiment, the Aβ peptide binding polypeptide is capable of binding to Aβ peptide such that the $K_D$ value of the interaction is at most $1\times10^{-7}$ M, such as at most $1\times10^{-8}$ M, such as at most $1\times10^{-9}$ M, such as at most $1\times10^{-10}$ M.

The skilled person will understand that various modifications and/or additions can be made to an Aβ peptide binding polypeptide according to the first aspect disclosed herein in order to tailor the polypeptide to a specific application without departing from the scope of the present disclosure.

For example, in one embodiment there is provided a fragment of an Aβ peptide binding polypeptide as disclosed herein, which fragment retains binding affinity for an Aβ peptide.

An Aβ peptide binding polypeptide encompassed by the present disclosure may comprise a number of additional amino acid residues. For example, in one embodiment, there is provided an Aβ peptide binding polypeptide as described herein, which polypeptide has been extended by and/or comprises at least one additional amino acid at at least one of the N terminus and the C terminus. Such a polypeptide should be understood as a polypeptide having one or more additional amino acid residues at the very first and/or the very last position in the polypeptide chain. Thus, an Aβ peptide binding polypeptide may comprise any suitable number of additional amino acid residues, for example at least one additional amino acid residue. Suitably, an Aβ peptide binding polypeptide with additional amino acids will retain binding affinity for an Aβ peptide.

Each additional amino acid residue may individually or collectively be added in order to, for example, improve or simplify production, purification, stabilization in vivo or in vitro, coupling or detection of the polypeptide. Such additional amino acid residues may for example comprise one or more amino acid residues added for the purpose of chemical coupling. One example of this is the addition of a cysteine residue. Additional amino acid residues may also provide a "tag" for purification or detection of the polypeptide, such as a $His_6$ tag, a $(HisGlu)_3$ tag ("HEHEHE" tag) or a "myc" (c-myc) tag or a "FLAG" tag for interaction with antibodies specific to the tag or immobilized metal affinity chromatography (IMAC) in the case of the $His_6$-tag.

The further amino acids as discussed above may be coupled to the Aβ peptide binding polypeptide by means of chemical conjugation (using known organic chemistry methods) or by any other means, such as expression of the Aβ peptide binding polypeptide as a fusion protein or joined in any other fashion, either directly or via a linker, for example an amino acid linker as discussed above.

Fusion proteins, or conjugates, in which an Aβ peptide binding polypeptide described herein constitutes a first domain (herein referred to as a first part), and which also comprises second and optionally further domains (herein referred to as second and further parts) are also contemplated and fall within the ambit of the present disclosure.

The second and optional further parts of the fusion polypeptide or conjugate suitably have a desired biological activity.

For example, such a desired biological activity could be binding to the same target, Aβ peptide, as the first part. In one embodiment, this second and optional further Aβ peptide binding part could comprise one or more additional polypeptides as disclosed in the first aspect above, making the fusion protein or conjugate a multimer (such as a dimer, trimer, tetramer etc) of Aβ peptide binding polypeptides as disclosed herein. The amino acid sequences of the individual, "monomer", polypeptide chains may be the same or different. Also contemplated are constructs in which the first part is as disclosed in the first aspect, whereas the second and optional further parts are not.

Thus, in a second aspect of the present disclosure, there is provided a fusion protein or a conjugate, comprising a first part consisting of an Aβ peptide binding polypeptide according to the first aspect, and a second part consisting of a polypeptide having a desired biological activity. In one embodiment, said fusion protein or conjugate may additionally comprise further parts, comprising desired biological activities that can be either the same or different from the biological activity of the first and/or second part. For the sake of clarity, the discussion to follow relating to said second part is equally relevant for any further parts which may be present in the fusion or conjugate as defined herein.

Non-limiting examples of a desired biological activity comprise a therapeutic activity, a binding activity and an enzymatic activity.

In one embodiment, the second part having a desired biological activity is a therapeutically active polypeptide.

Non-limiting examples of therapeutically active polypeptides are biomolecules, such as molecules selected from the group consisting of human endogenous enzymes, hormones, growth factors, chemokines, cytokines and lymphokines.

Non-limiting examples of binding activities are binding activities which increase the in vivo half-life of the fusion protein or conjugate. In one particular embodiment, said binding activity which increases the in vivo half-life of the fusion protein or conjugate is an albumin binding activity. In one embodiment, said albumin binding activity is provided by the albumin binding domain of streptococcal protein G or a derivative thereof, for example comprising the amino acid sequence SEQ ID NO: 107 or a derivative thereof. In another particular embodiment, said binding activity which increases the in vivo half-life of the fusion protein or conjugate is an FcRn binding activity. FcRn binding may for example be provided by an antibody or a fragment thereof having FcRn affinity (reviewed in Roopenian and Akilesh (2007), Nat Rev Immunol 7:715-725), or by a Z variant with engineered affinity for FcRn (Seijsing et al (2014), Proc Natl Acad Sci USA 111:17110-5).

A binding activity as discussed above may be a binding activity that acts to block a biological activity or a binding activity that acts to stimulate a biological activity. Specific, contemplated targets for binding of a second or optional further part are selected from the group consisting of Tau, apolipoprotein E (ApoE), beta-secretase 1 (BACE1), gamma-secretase, transferrin receptor (TfR), complement factor C1s, presenilin 1, presenilin 2, nicastrin, alpha-synuclein and Bri.

In one particular embodiment, the second part of said fusion protein or conjugate may comprise an antibody or an antigen binding fragment thereof. As is well known, antibodies are immunoglobulin molecules capable of specific binding to a target (an antigen), such as a carbohydrate, polynucleotide, lipid, polypeptide or other, through at least one antigen recognition site located in the variable region of the immunoglobulin molecule. As used herein, the term "antibody or an antigen binding fragment thereof" encompasses not only full-length or intact polyclonal or monoclonal antibodies, but also antigen-binding fragments thereof, such as Fab, Fab', F(ab')$_2$, Fab$_3$, Fv and variants thereof, fusion proteins comprising one or more antibody portions, humanized antibodies, chimeric antibodies, minibodies, diabodies, triabodies, tetrabodies, linear antibodies, single chain antibodies, multispecific antibodies (e.g., bispecific antibodies) and any other modified configuration of the immunoglobulin molecule that comprises an antigen recognition site of the required specificity, including glycosylation variants of antibodies, amino acid sequence variants of antibodies and covalently modified antibodies. Further examples of modified antibodies and antigen binding fragments thereof include nanobodies, AlbudAbs, DARTs (dual affinity re-targeting), BiTEs (bispecific T-cell engager), TandAbs (tandem diabodies), DAFs (dual acting Fab), two-in-one antibodies, SMIPs (small modular immunopharmaceuticals), FynomAbs (fynomers fused to antibodies), DVD-Igs (dual variable domain immunoglobulin), CovX-bodies (peptide modified antibodies), duobodies and triomAbs. This listing of variants of antibodies and antigen binding fragments thereof is not to be seen as limiting, and the skilled person is aware of other suitable variants.

A full-length antibody comprises two heavy chains and two light chains. Each heavy chain contains a heavy chain variable region ($V_H$) and first, second and third constant regions ($C_H1$, $C_H2$ and $C_H3$). Each light chain contains a light chain variable region ($V_L$) and a light chain constant region ($C_L$). Depending on the amino acid sequence of the constant domain of its heavy chains, antibodies are assigned to different classes. There are six major classes of antibodies: IgA, IgD, IgE, IgG, IgM and IgY, and several of these may be further divided into subclasses (isotypes), e.g., IgG1, IgG2, IgG3, IgG4, IgA1 and IgA2. The term "full-length antibody" as used herein refers to an antibody of any class, such as IgD, IgE, IgG, IgA, IgM or IgY (or any sub-class thereof). The subunit structures and three-dimensional configurations of different classes of antibodies are well known.

An "antigen binding fragment" is a portion or region of an antibody molecule, or a derivative thereof, that retains all or a significant part of the antigen binding of the corresponding full-length antibody. An antigen binding fragment may comprise the heavy chain variable region ($V_H$), the light chain variable region ($V_L$), or both. Each of the $V_H$ and $V_L$ typically contains three complementarity determining regions CDR1, CDR2 and CDR3. The three CDRs in $V_H$ or $V_L$ are flanked by framework regions (FR1, FR2, FR3 and FR4). As briefly listed above, examples of antigen binding fragments include, but are not limited to: (1) a Fab fragment, which is a monovalent fragment having a $V_L$—$C_L$ chain and a $V_H$-$C_H1$ chain; (2) a Fab' fragment, which is a Fab fragment with the heavy chain hinge region, (3) a F(ab')$_2$ fragment, which is a dimer of Fab' fragments joined by the heavy chain hinge region, for example linked by a disulfide bridge at the hinge region; (4) an Fc fragment; (5) an Fv fragment, which is the minimum antibody fragment having the $V_L$ and $V_H$ domains of a single arm of an antibody; (6) a single chain Fv (scFv) fragment, which is a single polypeptide chain in which the $V_H$ and $V_L$ domains of an scFv are linked by a peptide linker; (7) an (scFv)$_2$, which comprises two $V_H$ domains and two $V_L$ domains, which are associated through the two $V_H$ domains via disulfide bridges and (8) domain antibodies, which can be antibody single variable domain ($V_H$ or $V_L$) polypeptides that specifically bind antigens.

Antigen binding fragments can be prepared via routine methods. For example, F(ab')$_2$ fragments can be produced by pepsin digestion of a full-length antibody molecule, and Fab fragments can be generated by reducing the disulfide bridges of F(ab')$_2$ fragments. Alternatively, fragments can be prepared via recombinant technology by expressing the heavy and light chain fragments in suitable host cells (e.g., *E. coli*, yeast, mammalian, plant or insect cells) and having them assembled to form the desired antigen-binding fragments either in vivo or in vitro. A single-chain antibody can be prepared via recombinant technology by linking a nucleotide sequence coding for a heavy chain variable region and a nucleotide sequence coding for a light chain variable region. For example, a flexible linker may be incorporated between the two variable regions. The skilled person is aware of methods for the preparation of both full-length antibodies and antigen binding fragments thereof.

Thus, in one embodiment there is provided a fusion protein or conjugate as defined herein, wherein said at least one antibody or antigen binding fragment thereof is selected from the group consisting of full-length antibodies, Fab fragments, Fab' fragments, F(ab')$_2$ fragments, Fc fragments, Fv fragments, single chain Fv fragments, (scFv)$_2$ and domain antibodies. In one embodiment, said at least one antibody or antigen binding fragment thereof is selected from full-length antibodies, Fab fragments and scFv fragments. In one particular embodiment, said at least one antibody or antigen binding fragment thereof is a full-length antibody.

In one embodiment, the antibody or antigen binding fragment thereof is selected from the group consisting of monoclonal antibodies, human antibodies, humanized antibodies, chimeric antibodies, and antigen-binding fragments thereof.

The term "monoclonal antibodies" as used herein refers to antibodies having monovalent affinity, meaning that each antibody molecule in a sample of the monoclonal antibody binds to the same epitope on the antigen, whereas the term "polyclonal antibodies" as used herein refers to a collection of antibodies that react against a specific antigen, but in which collection there may be different antibody molecules for example identifying different epitopes on the antigen. Polyclonal antibodies are typically produced by inoculation of a suitable mammal and are purified from the mammal's serum. Monoclonal antibodies are made by identical immune cells that are clones of a unique parent cell (for example a hybridoma cell line). The term "human antibody" as used herein refers to antibodies having variable and constant regions corresponding substantially to, or derived from, antibodies obtained from human subjects. The term "chimeric antibodies" as used herein, refers to recombinant or genetically engineered antibodies, such as for example mouse monoclonal antibodies, which contain polypeptides or domains from a different species, for example human, introduced to reduce the antibodies' immunogenicity. The term "humanized antibodies" refers to antibodies from non-human species whose protein sequences have been modified to increase their similarity to antibody variants produced naturally in humans, in order to reduce immunogenicity.

In one embodiment, there is provided a fusion protein or a conjugate as disclosed herein, wherein antibody or antigen binding fragment thereof has affinity for a target selected from the group consisting of Tau, apolipoprotein E (ApoE), beta-secretase 1 (BACE1; Atwal et al (2011), Sci Transl Med 3:84ra43), gamma-secretase, transferrin receptor (TfR; Yu et al, (2014) Sci Transl Med 6:261 ra154), complement factor C1s, presenilin 1, presenilin 2, nicastrin, alpha-synuclein and Bri.

The blood-brain barrier (BBB) represents a major obstacle to the delivery of drugs to the central nervous system (CNS). The BBB is a highly selective permeability barrier that separates the circulating blood from the brain extracellular fluid in the central nervous system and one of its important functions is to block circulating substances from entering or exiting the CNS, which makes drug delivery to the brain challenging. It may therefore be beneficial to target the fusion protein or conjugate to the brain by fusion to a second part which promotes the transport across the BBB. The major mechanisms for delivery of substances into the CNS are transmembrane diffusion and saturable transport. Most CNS therapeutics are small, lipid soluble molecules that are likely to rely upon transmembrane diffusion to cross the BBB. Although peptides, and even some small proteins, have a measurable transmembrane diffusion, saturable transporters are believed to be the most effective mechanism for delivering these molecules into the CNS. Saturable transporters typically deliver 10 to 100 times more of their main ligand to the CNS than would occur with transmembrane diffusion. It may also be of interest to adapt the fusion protein or conjugate such that it can exit the CNS after having bound to the Aβ target, so that it may for example remove or sequester Aβ peptide more efficiently.

Thus, in one embodiment, there is provided a fusion protein or conjugate as disclosed herein, wherein the second part mediates transport of the fusion protein or conjugate to the cerebrospinal fluid and/or brain. In one embodiment, said second part is selected from the group consisting of transferrin, ghrelin, insulin and leptin; for example selected from transferrin and ghrelin.

In another embodiment, there is provided a fusion protein or conjugate as disclosed, wherein the second part mediates transport away from the cerebrospinal fluid and/or brain. In one such embodiment, said second part is selected from the group consisting of anti-FcRn antibodies (Roopenian and Akilesh (2007), supra) and FcRn-binding Z variants (Seijsing et al (2014), supra) as disclosed in the context of half-life extension above.

The disclosure furthermore encompasses polypeptides in which the Aβ peptide binding polypeptide according to the first aspect and as comprised in a fusion protein or conjugate according to the second aspect further comprises a label, such as a label selected from the group consisting of fluorescent dyes and metals, chromophoric dyes, chemiluminescent compounds and bioluminescent proteins, enzymes, radionuclides and radioactive particles. In other embodiments, the labeled Aβ peptide binding polypeptide is present as a moiety in a fusion protein or conjugate also comprising a second and optionally further parts having a desired biological activity. The label may in some instances be coupled only to the Aβ peptide binding polypeptide, and in some instances both to the Aβ peptide binding polypeptide and to the second part of the fusion protein or conjugate. Furthermore, it is also possible that the label may be coupled to a second part, and not to the Aβ peptide binding part. Hence, in yet another embodiment, there is provided a Aβ peptide binding polypeptide comprising a second part, wherein said label is coupled to the second part only. Such labels may for example be used for detection of the polypeptide in vivo or in vitro and be useful in diagnosis and therapy monitoring. The skilled person is aware of radionuclides which may be useful in for example positron emission tomography to detect Aβ and plaques thereof.

In one embodiment, said Aβ peptide binding polypeptide, fusion protein or conjugate as described herein comprises a chelating environment provided by a polyaminopolycarboxylate chelator conjugated to the Aβ peptide binding polypeptide via a thiol group of a cysteine residue or an amine group of a lysine residue.

In embodiments where the Aβ peptide binding polypeptide, fusion protein or conjugate is radiolabeled, such a radiolabeled polypeptide may comprise a radionuclide. A majority of radionuclides have a metallic nature and metals are typically incapable of forming stable covalent bonds with elements presented in proteins and peptides. For this reason, labeling of proteins and peptides with radioactive metals is performed with the use of chelators, i.e. multidentate ligands, which form non-covalent compounds, called chelates, with the metal ions. In an embodiment of the Aβ peptide binding polypeptide, fusion protein or conjugate, the incorporation of a radionuclide is enabled through the provision of a chelating environment, through which the radionuclide may be coordinated, chelated or complexed to the polypeptide.

One example of a chelator is the polyaminopolycarboxylate type of chelator. Two classes of such polyaminopolycarboxylate chelators can be distinguished: macrocyclic and acyclic chelators.

In one embodiment, the Aβ peptide binding polypeptide, fusion protein or conjugate comprises a chelating environment provided by a polyaminopolycarboxylate chelator conjugated to the Aβ peptide binding polypeptide via a thiol group of a cysteine residue or an epsilon amine group of a lysine residue.

The most commonly used macrocyclic chelators for radioisotopes of indium, gallium, yttrium, bismuth, radioactinides and radiolanthanides are different derivatives of DOTA (1,4,7,10-tetraazacyclododecane-1,4,7,10-tetraacetic acid). In one embodiment, a chelating environment of the Aβ peptide binding polypeptide, fusion protein or conjugate is provided by DOTA or a derivative thereof. More specifically, in one embodiment, the chelating polypeptides encompassed by the present disclosure are obtained by reacting the DOTA derivative 1,4,7,10-tetraazacyclododecane-1,4,7-trisacetic acid-10-maleimidoethylacetamide (maleimidomonoamide-DOTA) with said polypeptide.

Additionally, 1,4,7-triazacyclononane-1,4,7-triacetic acid (NOTA) and derivatives thereof may be used as chelators. Hence, in one embodiment, there is provided an Aβ binding polypeptide, fusion protein or conjugate, wherein the polyaminopolycarboxylate chelator is 1,4,7-triazacyclononane-1,4,7-triacetic acid or a derivative thereof.

The most commonly used acyclic polyaminopolycarboxylate chelators are different derivatives of DTPA (diethylenetriamine-pentaacetic acid). Hence, polypeptides having a chelating environment provided by diethylenetriaminepentaacetic acid or derivatives thereof are also encompassed by the present disclosure.

In a third aspect of the present disclosure, there is provided a polynucleotide encoding an Aβ peptide binding polypeptide or a fusion protein as described herein; an expression vector comprising said polynucleotide; and a host cell comprising said expression vector.

Also encompassed by this disclosure is a method of producing a polypeptide or fusion protein as described above, comprising culturing said host cell under conditions permissive of expression of said polypeptide from its expression vector, and isolating the polypeptide.

The Aβ peptide binding polypeptide of the present disclosure may alternatively be produced by non-biological peptide synthesis using amino acids and/or amino acid derivatives having protected reactive side-chains, the non-biological peptide synthesis comprising step-wise coupling of the amino acids and/or the amino acid derivatives to form a polypeptide according to the first aspect having protected reactive side-chains, removal of the protecting groups from the reactive side-chains of the polypeptide, and folding of the polypeptide in aqueous solution.

In another aspect, there is provided a composition comprising an Aβ peptide binding polypeptide, fusion protein or conjugate as described herein and at least one pharmaceutically acceptable excipient or carrier. In one embodiment, said composition further comprises at least one additional active agent, such as at least two additional active agents, such as at least three additional active agents. Non-limiting examples of additional active agents that may prove useful in such a composition are agents selected from the group consisting of inhibitors of neurotransmitter degradation, neurotransmitters, acetylcholinesterase inhibitors, NMDA receptor antagonists, TNF inhibitors, antihistamines, antiviral agents, alpha-secretase activators, inhibitors of beta- or gamma-secretase, inhibitors of α-synuclein aggregation, inhibitors of tau aggregation, calcium channel blockers, compounds effective against oxidative stress, anti-apoptotic compounds, metal chelators, inhibitors of DNA repair such as pirenzepin and metabolites, attractants for Aβ clearing/depleting cellular components, inhibitors of N-terminal truncated Aβ including pyroglutamated $A\beta_{3-42}$, anti-inflammatory molecules, atypical antipsychotics such as clozapine, ziprasidone, risperidone, aripiprazole and olanzapine, cholinesterase inhibitors (ChEIs) such as tacrine, rivastigmine, donepezil and galantamine, M1 agonists and other drugs including any amyloid or tau modifying drug and nutritive supplements such as vitamin B12, cysteine, acetylcholine precursor, lecithin, choline, *Ginkgo biloba*, acetyl-L-carnitine, idebenone, propentofylline, and xanthine derivatives. In one embodiment, the additional active agent(s) is/are selected from the group consisting of acetylcholinesterase inhibitors, NMDA receptor antagonists, TNF inhibitors, antihistamines and anti-viral agents.

The skilled person will appreciate that said Aβ peptide binding polypeptide, fusion protein or conjugate, or a composition comprising an Aβ peptide binding polypeptide, fusion protein or conjugate as described herein may be administered to a subject using standard administration techniques, such as including oral, intravenous, intraperitoneal, subcutaneous, intrathecal (e.g. via the Ommaya reservoir), pulmonary, transdermal, intramuscular, intranasal, buccal, sublingual or suppository administration. Thus, in one embodiment, there is provided a composition or an Aβ peptide binding polypeptide, fusion protein, conjugate as disclosed herein for administration via a route selected from the group consisting of oral, intravenous, intraperitoneal, subcutaneous, intrathecal, pulmonary, transdermal, intramuscular, intranasal, buccal, sublingual or suppository administration, such as selected from the group consisting of oral, intrathecal, intravenous and intranasal administration, in particular intranasal administration.

Aβ peptide may also serve as a marker for diagnosis and prognosis of Aβ peptide associated disorders, such as amyloidosis, which refers to a group of diseases and disorders associated with amyloid plaque formation including secondary amyloidosis and age-related amyloidosis including, but not limited to, neurological disorders or conditions characterized by a loss of cognitive memory capacity such as, for example, Alzheimer's disease (AD), mild cognitive impairment (MCI), Lewybody dementia, Down's syndrome, hereditary cerebral hemorrhage with amyloidosis (Dutch type), the Guam Parkinson-dementia complex; as well as other diseases which are based on or associated with amyloid-like proteins such as cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, and senile cardiac amyloidosis; and various eye diseases including glaucoma, macular degeneration, drusen-related optic neuropathy, and cataract due to beta-amyloid deposition.

The Aβ peptide binding polypeptide according to the present disclosure may be useful as a therapeutic, diagnostic or prognostic agent. Hence, in another aspect of the present disclosure, there is provided an Aβ peptide binding polypeptide, fusion protein, conjugate or composition as described herein for use as a medicament, a diagnostic agent or a prognostic agent.

It is envisioned that the administration of an Aβ peptide binding polypeptide, fusion protein, conjugate or composition as described herein to a subject afflicted with a disease characterized by an over-representation of Aβ, or by Aβ aggregates or Aβ deposits, would likely lower the Aβ toxicity and promote Aβ degradation in the subject (Luheshi et al (2010) PLOS Biology, March, Vol 8, Issue 3, e1000334). This, in turn, would also reduce the amount of insoluble Aβ in the body, because of the shift in equilibrium between soluble and aggregated forms of the amyloid beta peptide. Lowering the amounts of, and/or sequestering, Aβ in this fashion serves to reduce, and perhaps eliminate, the very source of the disease itself.

Thus, in one embodiment, there is provided an Aβ peptide binding polypeptide, fusion protein, conjugate or composition as described herein, for use as a medicament to reduce the amount of free Aβ peptide in blood. In one embodiment, there is provided an Aβ peptide binding polypeptide, fusion protein, conjugate or composition as described herein, for use as a medicament to slow down, stop or reverse the Aβ monomer-aggregate equilibrium. In one embodiment, there is provided an Aβ peptide binding polypeptide, fusion protein, conjugate or composition as described herein, for use as a medicament to prevent or reverse Aβ aggregate formation. The skilled person will appreciate that the three above mentioned modes of function of an Aβ peptide binding polypeptide, fusion protein, conjugate or composition as disclosed herein, are not mutually exclusive. Instead, an Aβ peptide binding polypeptide, fusion protein, conjugate or composition as disclosed herein may exert any one, two or all three effects at the same time, or at different time points, for example depending on the effective concentration of said Aβ peptide binding polypeptide, fusion protein, conjugate or composition in the patient treated as well as on the stage of the disease.

In one embodiment, there is provided an Aβ peptide binding polypeptide, fusion protein, conjugate or composition for use in the treatment, diagnosis or prognosis of a Aβ peptide associated condition selected from the group consisting of amyloidosis, which refers to a group of diseases and disorders associated with amyloid plaque formation including secondary amyloidosis and age-related amyloidosis including, but not limited to, neurological disorders or conditions characterized by a loss of cognitive memory capacity such as, for example, Alzheimer's disease (AD), mild cognitive impairment (MCI), Lewybody dementia, Down's syndrome, hereditary cerebral hemorrhage with amyloidosis (Dutch type), the Guam Parkinson-dementia complex; as well as other diseases which are based on or associated with amyloid-like proteins such as cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, and senile cardiac amyloidosis; and various eye diseases including glaucoma, macular degeneration, drusen-related optic neuropathy, and cataract due to beta-amyloid deposition. In one embodiment, the Aβ peptide associated condition is selected from the group consisting of dementia, cognitive impairment, Alzheimer's disease, cerebral amyloid angiopathy, Down's syndrome, type II diabetes, primary and secondary systemic amyloidosis, familial amyloid polyneuropathy 1, glaucoma and age-related macular degeneration. In one particular embodiment, said condition is Alzheimer's disease.

In a related aspect, there is provided a method of detecting Aβ peptide, comprising providing a sample suspected to contain Aβ peptide, contacting said sample with an Aβ peptide binding polypeptide, fusion protein, conjugate or composition as described herein, and detecting the binding of the Aβ peptide binding polypeptide, fusion protein, conjugate or composition to indicate the presence of Aβ peptide in the sample. In one embodiment, said method further comprises an intermediate washing step for removing non-bound polypeptide, fusion protein, conjugate or composition, after contacting the sample.

In one embodiment, said method is a diagnostic or prognostic method, for determining the presence of Aβ peptide in a subject, the method comprising the steps:
  contacting the subject, or a sample isolated from the subject, with an Aβ peptide binding polypeptide, fusion protein, conjugate or composition as described herein, and
  obtaining a value corresponding to the amount of the Aβ peptide binding polypeptide, fusion protein, conjugate or composition that has bound in said subject or to said sample.

In one embodiment, said method further comprises an intermediate washing step for removing non-bound polypeptide, fusion protein, conjugate or composition, after contacting the subject or sample and before obtaining a value.

In one embodiment, said method further comprises a step of comparing said value to a reference. Said reference may be scored by a numerical value, a threshold or a visual indicator, for example based on a color reaction. The skilled person will appreciate that different ways of comparison to a reference are known in the art and may be suitable for use.

In one embodiment of such a method, said subject is a mammalian subject, such as a human subject.

In one embodiment of such a method, said sample is a biological fluid sample, such as sample selected form the group consisting of a whole blood sample, a plasma sample and a serum sample.

In another embodiment of such a method, said sample is a tissue sample.

In one embodiment, said method is performed in vivo.
In one embodiment, said method is performed in vitro.
In a related aspect, there is provided a method of treatment of an Aβ peptide associated condition, comprising administering to a subject in need thereof an effective amount of an Aβ peptide binding polypeptide, fusion protein, conjugate or composition as described herein. In a more specific embodiment of said method, the Aβ peptide binding polypeptide, fusion protein, conjugate or composition as described herein reduces the amount of free Aβ peptide in blood; slows down, stops or reverses the Aβ monomer-aggregate equilibrium; prevents or reverses Aβ aggregate formation; or a combination thereof.

In one embodiment, said Aβ peptide associated condition is selected from the group consisting of amyloidosis, which refers to a group of diseases and disorders associated with amyloid plaque formation including secondary amyloidosis and age-related amyloidosis including, but not limited to, neurological disorders or conditions characterized by a loss of cognitive memory capacity such as, for example, Alzheimer's disease (AD), mild cognitive impairment (MCI), Lewybody dementia, Down's syndrome, hereditary cerebral hemorrhage with amyloidosis (Dutch type), the Guam Parkinson-dementia complex; as well as other diseases which are based on or associated with amyloid-like proteins such as cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, and senile cardiac amyloidosis; and various eye diseases including glaucoma, macular degeneration, drusen-related optic neuropathy, and cataract due to beta-amyloid deposition. In one embodiment, the Aβ peptide associated condition is selected from the group consisting of dementia, cognitive impairment, Alzheimer's disease, cerebral amyloid angiopathy, Down's syndrome, type II diabetes, primary and secondary systemic amyloidosis, familial amyloid polyneuropathy 1, glaucoma and age-related macular degeneration. In one particular embodiment of said aspect, the Aβ peptide associated condition is Alzheimer's disease.

It may be beneficial to administer a therapeutically effective amount of an Aβ peptide polypeptide, fusion protein, conjugate or composition as described herein and at least one second drug substance, such as an agent selected from the group consisting of inhibitors of neurotransmitter degradation, neurotransmitters, acetylcholinesterase inhibitors, NMDA receptor antagonists, TNF inhibitors, antihistamines, anti-viral agents, alpha-secretase activators, inhibitors of beta- or gamma-secretase, inhibitors of α-synuclein aggregation, inhibitors of tau aggregation, calcium channel blockers, compounds effective against oxidative stress, anti-apoptotic compounds, metal chelators, inhibitors of DNA repair such as pirenzepin and metabolites, attractants for Aβ clearing/depleting cellular components, inhibitors of N-terminal truncated Aβ including pyroglutamated $A\beta_{3\text{-}42}$, anti-inflammatory molecules, atypical antipsychotics such as clozapine, ziprasidone, risperidone, aripiprazole and olanzapine, cholinesterase inhibitors (ChEIs) such as tacrine, rivastigmine, donepezil and galantamine, M1 agonists and other drugs including any amyloid or tau modifying drug and nutritive supplements such as vitamin B12, cysteine, acetylcholine precursor, lecithin, choline, *Ginkgo biloba*, acetyl-L-carnitine, idebenone, propentofylline, and xanthine derivatives. In one embodiment, the at least one second drug substance is selected from the group consisting of acetylcholinesterase inhibitors, NMDA receptor antagonists, TNF inhibitors, antihistamines and anti-viral agents.

As used herein, the term "co-administration" encompasses concomitant administration and administration in sequence. Thus, in one embodiment there is provided a method as defined above further comprising co-administration of at least one of the agents described above.

According to another aspect of the present invention, a method of separation, removal and/or purification of the Aβ peptide is provided. Suitably, such method involves a separation device, such as chosen among chromatographic media, membranes, cellulose, silica, agarose, polyacrylamide, magnetic beads, two-phase systems and other such materials commonly used in separation. In an embodiment, Aβ peptide binding polypeptide, fusion protein or conjugate as described herein is coupled to the separation device. The thus obtained separation device, having said Aβ peptide binding polypeptide, fusion protein or conjugate coupled thereto, is referred to as an affinity matrix. Thus, in one aspect of the present disclosure, there is provided an affinity matrix comprising Aβ peptide binding polypeptide, fusion protein or conjugate as described herein.

The method comprises a step of affinity separation, in which step an affinity matrix comprising an Aβ peptide binding polypeptide, fusion protein or conjugate as described herein is used.

For the purposes of purification of Aβ peptide from a sample, the sample containing Aβ to be purified is suitably applied to such an affinity matrix under conditions permissive for binding of Aβ peptide to the matrix. Thereafter, the affinity matrix is washed under conditions such that the binding of the Aβ peptide to the matrix is maintained, but most, ideally all, other proteins and contaminants bound to the matrix are washed away. In an elution step, the matrix is treated such that Aβ peptide is released from the matrix in an Aβ peptide enriched fraction denoted "Aβ3 peptide fraction", which may be recovered.

If, conversely, the purpose of the separation is the removal of Aβ peptide, essentially the same steps as above are suitably followed, with some exceptions. The sample containing Aβ peptide to be removed is suitably applied to an affinity matrix under conditions that are permissive for binding of Aβ peptide to the matrix. Thereafter, the affinity matrix is washed under conditions such that the binding of Aβ peptide to the matrix is maintained, but most, ideally all, other proteins are recovered in the flow-through, thus obtaining a "depleted fraction" with a substantial reduction in Aβ peptide content, which is recovered. The non-Aβ3 constituents of the sample may be retained and used and/or processed further.

Another related aspect of the disclosure is a method for reducing the content of Aβ peptide in a portion of a body fluid of a human, comprising the steps:

a) providing a portion of a body fluid from a human;

b) applying the portion to an affinity matrix as described herein, under conditions permissive for binding of the Aβ peptide to said affinity matrix, thereby causing a reduction of the content of Aβ peptide in the portion of body fluid; and c) returning at least a part of said portion of body fluid to said human.

The method according to the disclosure may be directed to reducing the content of Aβ peptide in a body fluid of a subject afflicted by an Aβ peptide associated condition selected from the group consisting of dementia, cognitive impairment, Alzheimer's disease, cerebral amyloid angiopathy, Down's syndrome, type II diabetes, primary and secondary systemic amyloidosis, familial amyloid polyneuropathy 1, glaucoma and age-related macular degeneration, such as Alzheimer's disease. The body fluid may for example be whole blood, plasma or serum. Thus, by using the method according to the invention, subjects afflicted by said Aβ peptide associated condition could be treated by extracorporeal removal of Aβ.

While the invention has been described with reference to various exemplary aspects and embodiments, it will be understood by those skilled in the art that various changes may be made and equivalents may be substituted for elements thereof without departing from the scope of the invention. In addition, many modifications may be made to adapt a particular situation or molecule to the teachings of the invention without departing from the essential scope thereof.

Therefore, it is intended that the invention not be limited to any particular embodiment contemplated, but that the invention will include all embodiments falling within the scope of the appended claims.

BRIEF DESCRIPTION OF THE FIGURES

FIGS. 1A-1X are a listing of the amino acid sequences of examples of Aβ peptide binding polypeptides of the present disclosure (SEQ ID NO:1-106, 115 and 118-553), the albumin binding domain PP013 (SEQ ID NO:107); a control polypeptide with affinity for an irrelevant target ($Z_{Taq}$; SEQ ID NO:108); human $Aβ_{1-42}$ peptide (SEQ ID NO:109); human $Aβ_{1-40}$ peptide (SEQ ID NO:110); and amino acid sequences for control peptides $Z_{Aβ3}$ (SEQ ID NO:111), $(Z_{Aβ3})_2$ (SEQ ID NO:112), $(Z_{Aβ3,A12})_2$ (SEQ ID NO:113), albumin binding polypeptide ABP (SEQ ID NO:114), $(Z_{Taq})_2$-PP013 (SEQ ID NO:116) and the albumin binding domain GA3 from streptococcal Protein G, "ABD" (SEQ ID NO:117) used in selection, screening and/or characterization of the binding polypeptides of the disclosure. The deduced Aβ peptide binding motifs BM1 and BM2 of the Aβ peptide binding polypeptides disclosed herein extend from residue 4 to residue 25 and from residue 64 to residue 85, respectively, in the sequences with SEQ ID NO:1-17, 19-106 and 118-553. In SEQ ID NO:18, BM1 and BM2 extend from residue 4 to residue 25 and from residue 69 to residue 90, respectively.

Figure 5A:
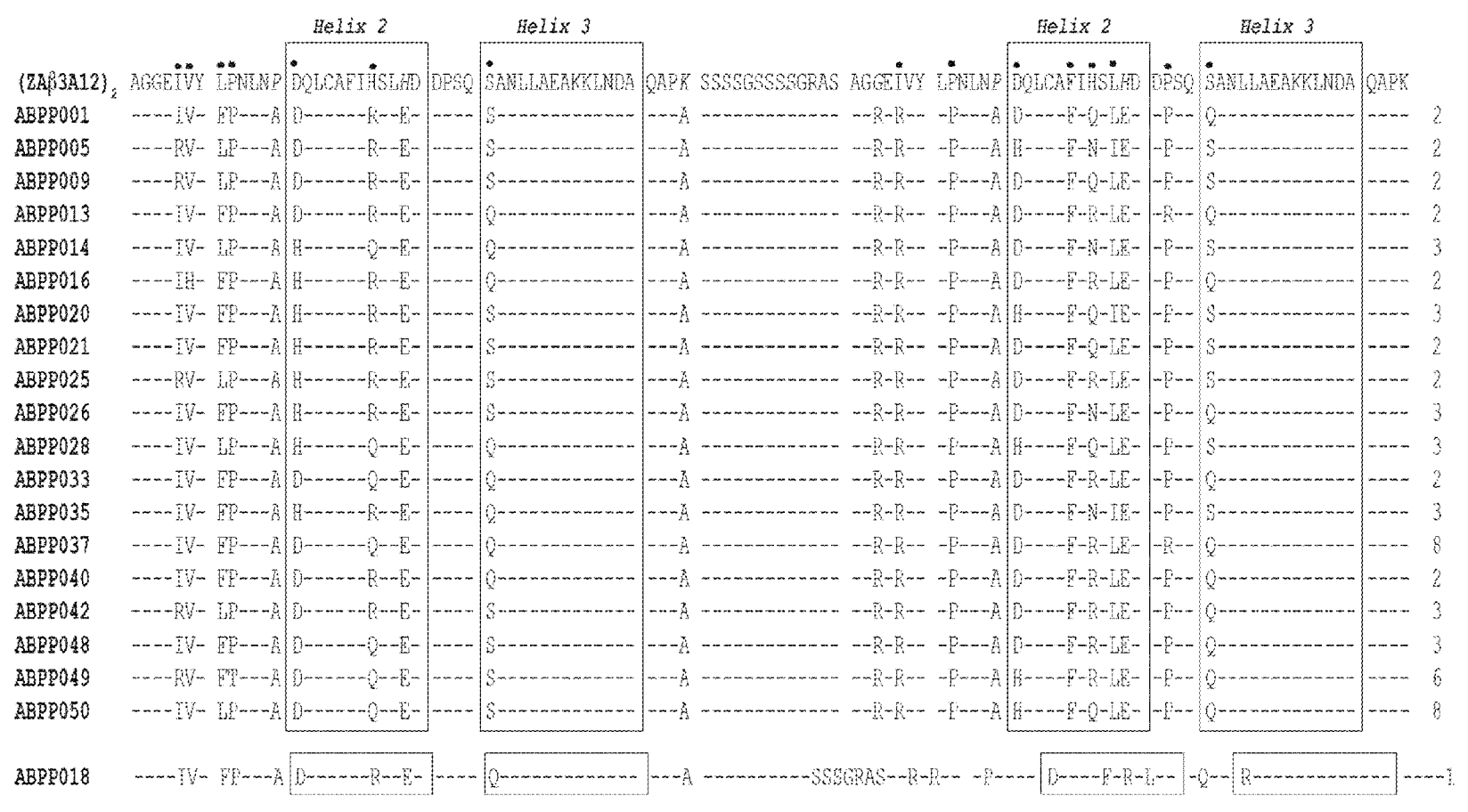
Figure 5B:
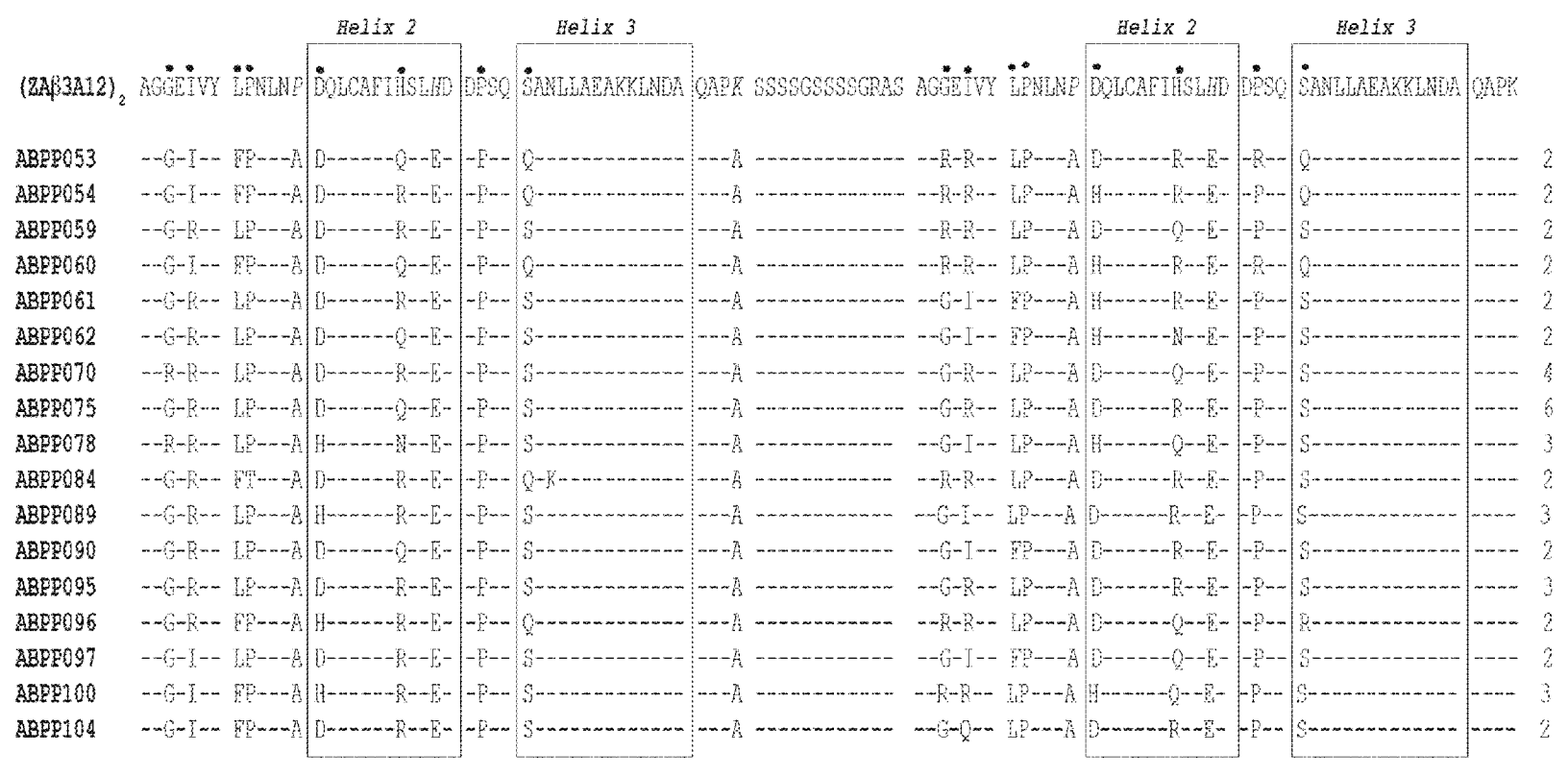

FIGS. 5A and 5B show the amino acid sequences of $(Z_{A\beta3A12})_2$ (SEQ ID NO: 113) together with the affinity matured Aβ peptide binding polypeptides isolated by FACS from the asymmetric library (ABPP001, 005, 009, 013, 014, 016, 018, 020, 021, 025, 026, 028, 033, 035, 037, 040, 042, 048, 049 and 050, corresponding to SEQ ID NO:1, 5, 9, 13, 14, 16, 18, 20, 21, 25, 26, 28, 33, 35, 37, 40, 42, 48, 49 and 50, respectively) and from the symmetric library (ABPP053, 054, 059, 060, 061, 062, 070, 075, 078, 084, 089, 090, 095, 096, 097, 100 and 104, corresponding to SEQ ID NO:53, 54, 59, 60, 61, 62, 70, 75, 78, 84, 89, 90, 95, 96, 97, 100 and 104, respectively). The $(S_4G)_2$ (SEQ ID NO:633) linker is outlined between the first and second moieties. Randomized positions are indicated by dots and positions that have been mutated in the original scaffold are shown. The number of times each clone was isolated is shown to the right of each sequence.

FIGS. 12A and 12B show results from the behavioral tests described in Example 8. FIG. 12A shows bar graphs of maximum velocity (Vmax), average velocity (Vmean), distance traveled and resting time obtained from 10 (2×Tg) sweAPP/PS1 mice treated with ABPP095-PP013 (SEQ ID NO:115) and 10 (2×Tg) sweAPP/PS1 mice treated with $(Z_{Taq})_2$-PP013 (SEQ ID NO:116; control) as measured by the locomotor activity test. FIG. 12B shows bargraphs of running speed obtained from 10 (2×Tg) sweAPP/PS1 mice treated with ABPP095-PP013 and 10 (2×Tg) sweAPP/PS1 mice treated with $(Z_{Taq})_2$-PP013 measured by the rotarod test.

EXAMPLES

Summary

Figure 2:
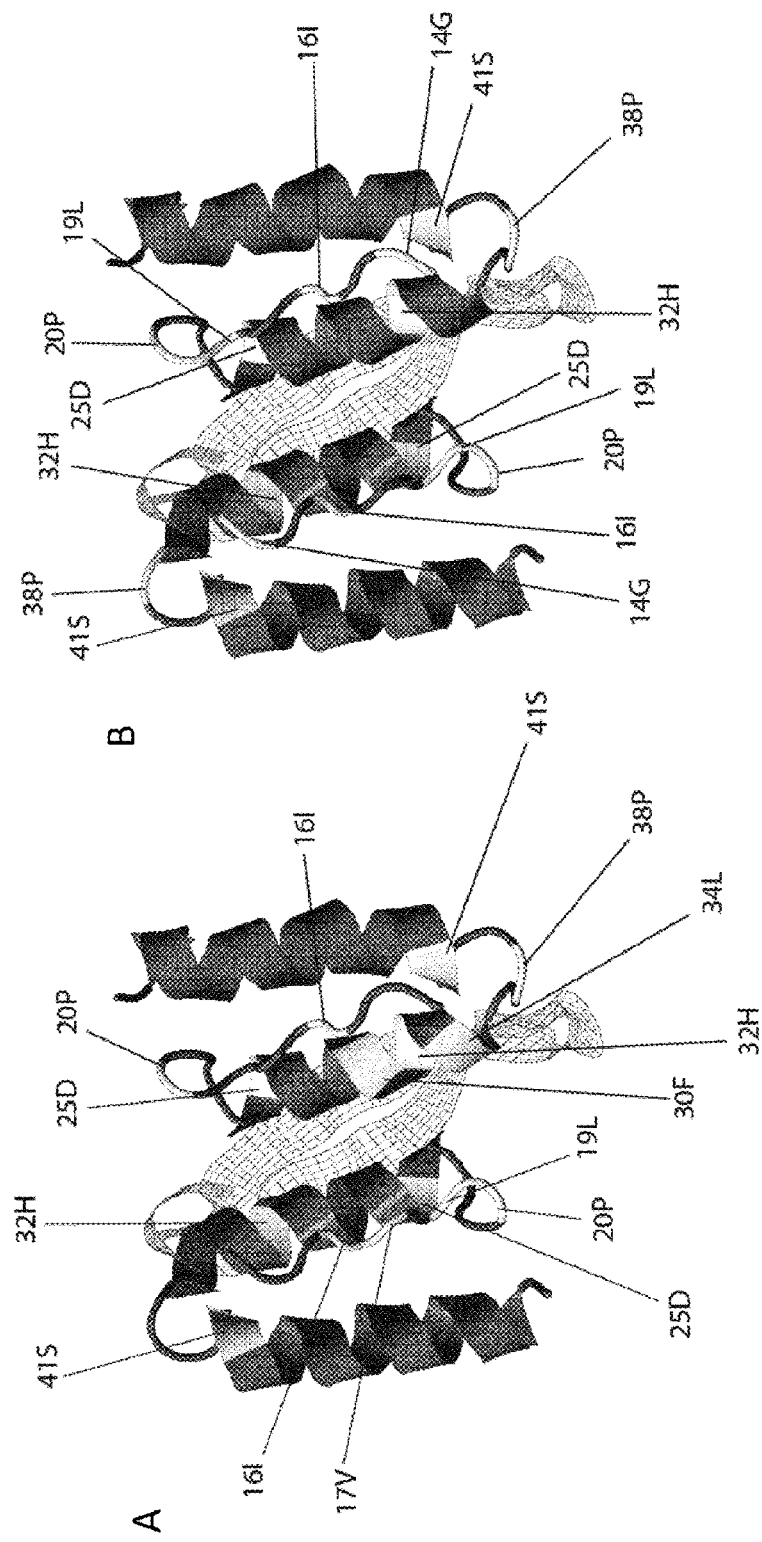
FIG. 2 is a structural overview of the design of the truncated head-to-tail linked dimeric asymmetric library (A), denoted ZASlib, and symmetric library Z (B), denoted ZSYMlib, shown in complex with the $Aβ_{1-40}$ peptide (white mesh ribbon) (Protein Data Bank entry 2OTK). Randomized positions in respective library are indicated, with numbering referring to the respective position in a full-length Z variant.

The following Examples disclose the development of novel Aβ peptide binding polypeptides based on staphylococcal display technology. The genes encoding the Aβ peptide binding polypeptides described herein were sequenced, and the corresponding amino acid sequences are listed in FIG. 1A-1X and denoted by the identifiers SEQ ID NO:1-106 and 118-553. The Examples also describe the generation, characterization and functionality of the Aβ peptide binding polypeptides.

To clarify, the term "Z variant", as used herein, denotes target binding polypeptides derived from protein Z. Thus, the Aβ peptide binding polypeptides as described herein comprise dimers of a first Z variant unit and a second Z variant unit, wherein said units may be Z variants which are truncated at the N-terminal end.

Example 1

Design and cloning of affinity maturation libraries

Summary

This Example describes the design and cloning of two affinity maturation libraries, ZASlib and ZSYMlib, based on dimers of the previously identified first generation Aβ peptide binding polypeptide variant $Z_{Aβ3}$ (SEQ ID NO:111).

Materials and Methods

Two SlonoMax® head-to-tail dimer libraries of double-stranded DNA were purchased from Sloning BioTechnology GmbH (Pucheim, Germany). Library oligonucleotides encoded the truncated helix 1 plus helix 2 and 3 of the first Z variant unit and helix 1 and 2 of the second Z variant unit, making up the first and second moieties of the Aβ peptide binding polypeptides (asymmetric library: 5'-GCG GGT GGG GAG NNN NNN TAT NNN NNN AAC TTA AAC GCG NNN CAA CTG TGT GCC TTC ATC NNN AGT TTA GAA GAT GAC CCA AGC CAA NNN GCT AAC TTG TTG GCA GAA GCT AAA AAG CTA AAT GAT GCT CAG GCG CCG GCG AGC AGC AGC AGC GGG AGC AGC AGC AGC GGG CGC GCG AGT GCG GGT CGC GAG NNN GTT TAT TTA NNN AAC TTA AAC GCG NNN CAA CTG TGT GCC NNN ATC NNN AGT NNN GAA GAT GAC NNN AGC CAA NNN GCT AAC TT-3' (SEQ ID NO:556; randomized codons denoted NNN); symmetric library: 5'-GCG GGT NNN GAG NNN GTT TAT NNN NNN AAC TTA AAC GCG NNN CAA CTG TGT GCC TTC ATC NNN AGT TTA GAA GAT GAC NNN AGC CAA NNN GCT AAC TTG TTG GCA GAA GCT AAA AAG CTA AAT GAT GCT CAG GCG CCG GCG AGC AGC AGC AGC GGG AGC AGC AGC AGC GGG CGC GCG AGT GCG GGT NNN GAG NNN GTT TAT NNN NNN AAC TTA AAC GCG NNN CAA CTG TGT GCC TTC ATC NNN AGT TTA GAA GAT GAC NNN AGC CAA NNN GCT AAC TT-3' (SEQ ID NO:557; randomized codons denoted NNN). The genes were flanked with XhoI and NheI restriction sites for subcloning into the staphylococcal vector. The libraries were PCR amplified in 8 cycles using Phusion DNA polymerase (Finnzymes, Espoo, Finland), and the final PCR products were purified using a QIAquick PCR purification kit (Qiagen GmbH). Purified PCR products were digested by XhoI and NheI-HF (New England Biolabs) restriction enzymes and purified by preparative gel electrophoresis (2% agarose gel) using QIAquick gel extraction kit (Qiagen GmbH). The *S. carnosus* expression vector pSCZ1 (Löfblom et al (2007) J Appl Microbiol 102(3):736-747) was digested by the same enzymes and purified by preparative gel electrophoresis as described above. Purified library fragments were ligated into the vector using T4 DNA ligase (New England Biolabs) at a 1:5 molar ratio of vector to insert, followed by phenol-chloroform extraction and ethanol precipitation for purification and concentration of DNA fragments. Next, the library-encoding plasmids were transformed into electrocompetent *E. coli* SS320 cells (Lucigen Corporation, Middleton, USA) by electroporation. Individual clones were PCR amplified for subsequent library sequence validation using BigDye Thermo Cycle Sequencing reactions and an ABI Prism 3700 instrument (Applied Biosystems, Foster City, Calif.). Library plasmids were subsequently prepared using a Jetstar Maxi Kit (Genomed), purified by phenol-chloroform extraction and concentrated by isopropanol precipitation. Finally, the libraries (hereafter denoted Sc:ZASlib and Sc:ZSYMlib) were transformed into electrocompetent *S. carnosus* as previously described (Löfblom et al (2007), supra).

To verify that the libraries were functionally displayed on the staphylococcal surface, cells were incubated with fluorescently labeled human serum albumin (HSA; Kabi Pharmacia) and analyzed using flow cytometry. Labeling of HSA with Alexa Fluor 647 succinimidyl ester (Invitrogen) was performed according to the supplier's recommendations.

Results

In order to improve affinity for the Aβ peptide, an affinity maturation of Aβ peptide binding polypeptides was performed. Two affinity maturation libraries were designed based on a head-to-tail dimer of the first-generation Aβ peptide binding polypeptide $Z_{Aβ3}$ (SEQ ID NO:111). The libraries were designed as single-chain dimers to enable independent engineering of respective domain as well as to make them less susceptible to reducing conditions. Previous data show that truncating the first eleven, unstructured, amino acid residues from the N-terminus of a dimer of the first-generation Aβ peptide binding polypeptide $Z_{Aβ3}$ has positive effects on the affinity for Aβ peptide (Lindgren et al (2010) Protein Sci 19(12):2319-2329; Lindberg et al (2013) Biotechnol J 8(1):139-145). This portion of the first Z variant unit was therefore excluded in the libraries. In the second Z variant unit, the corresponding portion was instead substituted by a flexible $(S_4G)_2$ (SEQ ID NO:633) linker, in order to allow correct folding of the dimeric construct. The design of the randomizations in both libraries was based on structural analysis of the interaction of the first generation Aβ peptide binding polypeptide with the Aβ peptide, and on the sequence output from the selection of first generation Aβ peptide binding polypeptides (Gronwall et al (2007), supra; Hoyer et al (2008), supra).

Figure 3A:
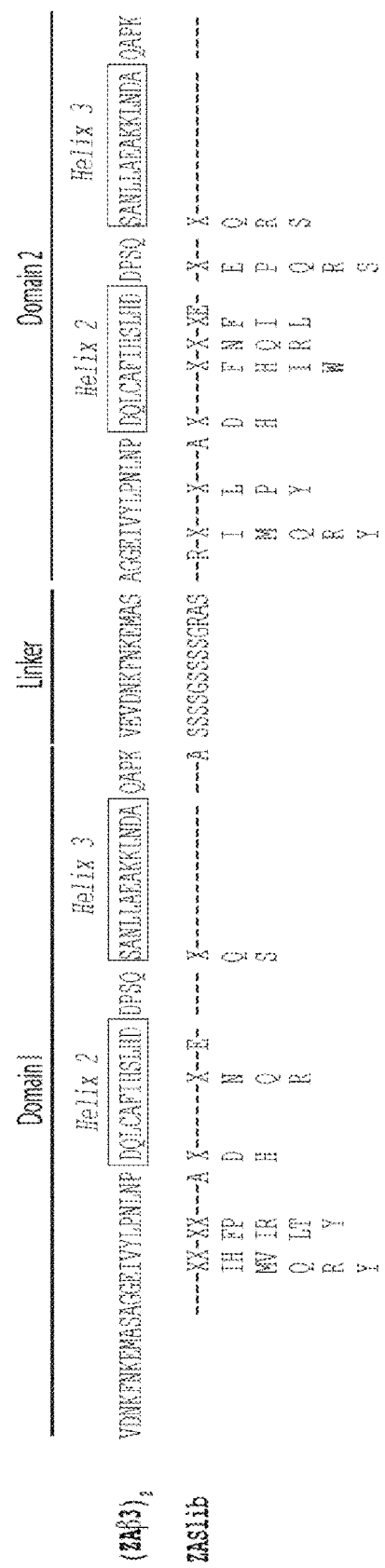
FIGS. 3A and 3B are a schematic comparison between a head-to-tail dimer of the first-generation Aβ peptide $Z_{Aβ3}$, herein denoted $(Z_{Aβ3})_2$ (SEQ ID NO:112) and the two affinity maturation libraries (A) ZASlib and (B) ZSYMlib. Amino acid sequence positions that are randomized in the libraries are indicated by X and the allowed amino acids in these positions for each library are indicated.
Figure 3B:
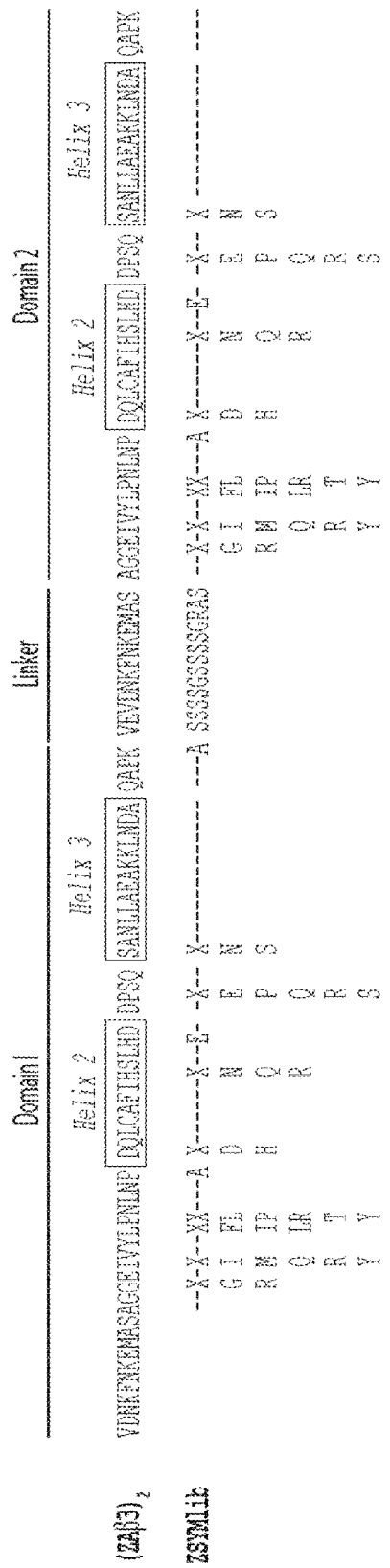

Different approaches were used for randomization of the libraries. In one library, different positions on the two Z variant units were targeted for randomization (asymmetric randomization), whereas in the other library, the same positions in both Z variant units were randomized (symmetric randomization). In the first approach, 15 asymmetrically distributed positions in both Z variant units were partially randomized (library denoted ZASlib; FIG. 2A). In the second approach, 16 symmetrically distributed positions (eight in each Z variant unit) were partially randomized (library denoted ZSYMlib; FIG. 2B). Each randomized position was spiked to 50-75% with the codon for the original amino acid, combined with a mix of codons for 1-4 other amino acids, resulting in a relatively low mutation frequency. To enable the construction of complex randomized DNA oligos, sets of trinucleotide building blocks were combined during production (Slonomics® technology). This method provided complete freedom when selecting codons for the library and allowed randomizations with minimal biases compared to degenerate codons and error-prone PCR approaches. The designs resulted in theoretical library complexities of $8.1 \times 10^7$ (ZASlib) and $2.33 \times 10^7$ (ZSYMlib) individual oligonucleotides. The library designs are outlined in FIG. 3.

The oligonucleotide mixtures encoding the two libraries were subcloned into the staphylococcal display vector pSCZ1 in fusion to an albumin binding polypeptide (ABP; SEQ ID NO:114) (Löfblom (2007), supra) and transformed into *S. carnosus* to generate libraries displayed on bacteria, with diversities of approximately $1 \times 10^8$ (ZASlib) and $1.3 \times 10^7$ (ZSYMlib). Sequence analysis of individual library members revealed a distribution of codons in accordance with the theoretical design, and no occurrence of undesired codons was observed. However, about 10% of ZSYMlib did not have a complete $(S_4G)_2$ linker. To verify that the libraries were functionally displayed on the staphylococcal surface, cells were incubated with fluorescently labeled HSA and analyzed using flow cytometry. Around 60-67% of the population displayed surface-exposed recombinant proteins, as assessed by functional albumin binding reporter protein.

Figure 4:
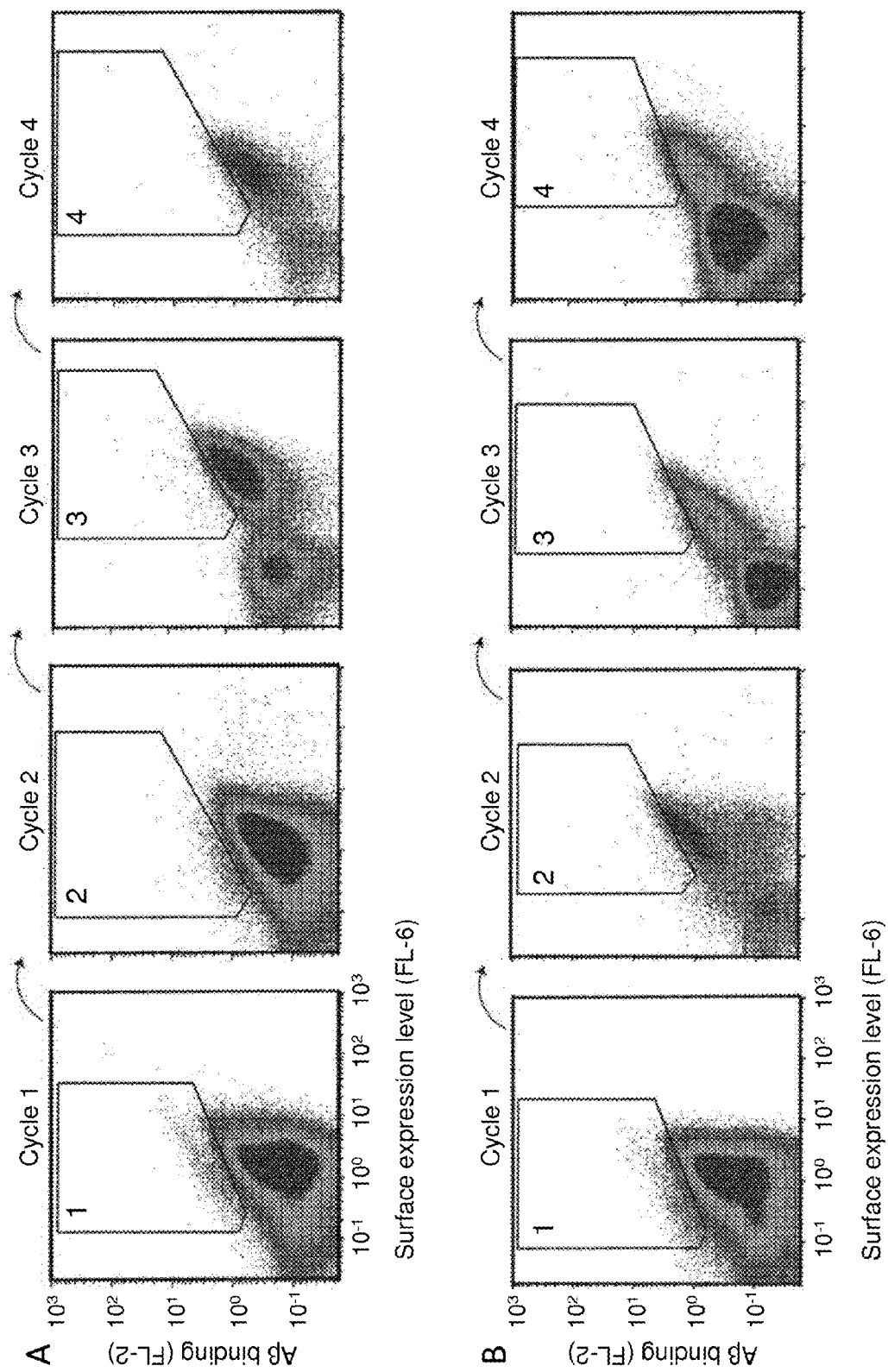
FIG. 4 are scatter plots showing the results of flow-cytometric sorting of (A) ZASlib and (B) ZSYMlib. Fluorescence intensity on the X axes corresponds to the surface expression level monitored via HSA binding to the albumin binding polypeptide ABP (SEQ ID NO:114) expressed as an integral part of the surface-exposed proteins. Fluorescence intensity on the Y axes corresponds to Aβ binding. The scatter plots show the staphylococcal library before flow-cytometric sorting in cycles 1, 2, 3 and 4, respectively, with regions used for gating outlined in each plot. Note that the concentration of biotinylated Aβ peptide is decreased in each sorting cycle and that off-rate selection was performed in the last cycle, resulting in decreasing signal intensities on average in subsequent rounds.

When incubated with labeled Aβ$_{1-40}$, both libraries demonstrated a fraction of clones having retained target binding (FIG. 4, cycle 1).

Example 2

Flow Cytometric Sorting of Affinity Maturation Libraries and Sequencing of Isolated Polypeptides Summary This Example describes the cloning of the affinity maturation libraries of Example 1 into a vector for staphylococcal display, and subsequent sorting and selection of Aβ peptide binding polypeptides by flow cytometry utilizing increased stringency conditions in each sorting cycle. Sequencing of isolated variants lead to the identification of 51 unique variants from the asymmetric library (SEQ ID NO:1-51) and 55 unique variants from the symmetric library (SEQ ID NO:52-106).

Materials and Methods

At least ten times the library size of either library was inoculated to tryptic soy broth supplemented with yeast extract (TSB+Y; Merck, Darmstadt, Germany) and 20 µg/ml chloramphenicol, and grown overnight at 37° C. and 150 rpm. The following day, cells were harvested by centrifugation (6000 rpm, 6 min, 4° C.) and washed in phosphate-buffered saline supplemented with 0.1% Pluronic® F108 NF Surfactant (PBSP; pH 7.4; BASF Corporation) before addition of C-terminally biotinylated Aβ$_{1-40}$ peptide (SEQ ID NO:110; AnaSpec). Cells were incubated with gentle mixing at room temperature for 45 minutes until equilibrium was reached. Subsequently, cells were washed with ice-cold PBSP and labeled with streptavidin conjugated with phycoerythrin (SAPE; Invitrogen) as well as HSA conjugated with Alexa Fluor 647 for 30 minutes on ice at concentrations of 5 µg/ml and 150 nM, respectively. After a final washing step in ice-cold PBSP, cells were resuspended in ice-cold PBSP prior to sorting. Cells were sorted in four cycles with an increased stringency in each cycle, using a MoFlo® Astrios flow cytometer (Beckman Coulter). In the first cycle of selection, library cells were incubated with 50 nM C-terminally biotinylated Aβ$_{1-40}$ peptide, and with 20 nM and 10 nM, respectively, in the second and third cycles. In the last cycle, the cells were subjected to an off-rate selection procedure.

In the final, off-rate selection cycle, enriched library cells were incubated with 25 nM C-terminally biotinylated Aβ$_{1-40}$ peptide for 45 minutes to reach equilibrium binding, washed in ice-cold PBSP, incubated with 100 nM unlabeled Aβ$_{1-40}$ peptide for 6 h and then labeled with HSA-Alexa Fluor 647 and SAPE prior to FACS sorting. In each sorting cycle, approximately ten times the library size was analyzed in the flow cytometer and the top fraction of cells (approximately 0.35%) with the highest ratio of Aβ$_{1-40}$-binding to cell surface expression fluorescence was gated and sorted directly into TSB+Y. Sorted cells were inoculated to TSB+Y supplemented with chloramphenicol (10 µg/ml) for overnight amplification at 37° C. with 150 rpm shaking, prior to the next cycle of FACS.

After the final cycle of sorting, cells were spread onto agar plates containing 10 µg/ml chloramphenicol. 96 randomly picked colonies from each sorted library were sequenced using BigDye Thermo Cycle Sequencing reactions and an ABI Prism 3700 (Applied Biosystems).

Results

Staphylococcal display technology in combination with fluorescence-activated cell sorting (FACS) is well suited for affinity maturation purposes, since it offers fine affinity discrimination between individual library members (Löfblom (2007) supra; Kronqvist (2008) Protein Eng Des Sel 21(4):247-255; Maim et al (2013) PLoS One 8(5): e62791). In order to isolate high-affinity Aβ peptide binding polypeptides, the two displayed libraries were subjected to four cycles of FACS. Staphylococcal cells were incubated with biotinylated Aβ$_{1-40}$ peptide for 45 min at room temperature to reach binding equilibrium. Cells were thereafter washed and incubated on ice with fluorescently labeled HSA and streptavidin-conjugated phycoerythrin, for detection and normalization of the target binding with cell surface expression level as described previously (Kronqvist et al (2008) supra). After additional washing, library cells demonstrating the highest target-binding to surface-expression ratio in the flow cytometer were gated (as outlined in FIG. 4) and isolated for amplification and subsequent rounds of sorting. In each cycle, the selection stringency was increased by changing sorting parameters and gates, as well as by decreasing the target concentration to 50 nM, 20, nM and 10 nM in cycles 1, 2 and 3, respectively. In the fourth and final cycle, an off-rate selection approach was used to favor binders with the slowest dissociation. As shown by flow-cytometric analysis after each cycle of selection, the sorting resulted in enrichment of Aβ binding clones (FIGS. 4A and 4B). After four cycles of sorting, individual colonies were sequenced for identification. Out of a total of 192 sequences (96 per library), 51 unique polypeptide variants (SEQ ID NO:1-51) were identified in the output from the asymmetric library and 55 unique polypeptide variants (SEQ ID NO:52-106) were identified in the output from the symmetric library (FIG. 1). Interestingly, one isolated clone (ABPP018, SEQ ID NO:18) from the asymmetric library contained a linker consisting of three S$_4$G repeats instead of the two that were intended by design.

Example 3

On-Cell Screening for Aβ Binding

Summary

In this Example, the affinity of 37 isolated polypeptide variants for Aβ peptide was analyzed by flow cytometry.

Materials and Methods 37 clones (ABPP001, 005, 009, 013, 014, 016, 018, 020, 021, 025, 026, 028, 033, 035, 037, 040, 042, 048, 049 and 050, corresponding to SEQ ID NO:1, 5, 9, 13, 14, 16, 18, 20, 21, 25, 26, 28, 33, 35, 37, 40, 42, 48, 49 and 50, respectively; and ABPP053, 054, 059, 060, 061, 062, 070, 075, 078, 084, 089, 090, 095, 096, 097, 100 and 104, corresponding to SEQ ID NO:53, 54, 59, 60, 61, 62, 70, 75, 78, 84, 89, 90, 95, 96, 97, 100 and 104, respectively), each occurring more than once in the selection results of Example 2, were individually inoculated to TSB+Y with chloramphenicol (10 µg/ml) and grown overnight at 37° C. and 150 rpm. $10^6$ overnight-cultured cells were pelleted by centrifugation and washed in PBSP before resuspension in 1 nM biotinylated Aβ$_{1-40}$ (AnaSpec). After 45 min incubation at room temperature with gentle mixing, cells were washed with ice-cold PBSP and labeled with SAPE and HSA-Alexa Fluor 647 for 30 minutes on ice. Next, cells were washed and resuspended in ice-cold PBSP, and subjected to flow-cytometric analysis. The mean fluorescence intensities (MFI) from Aβ$_{1-40}$ binding and cell surface expression were measured in a Gallios flow cytometer (Beckman Coulter). The head-to-tail homodimer of the first-generation binder (Z$_{Aβ3}$)$_2$ (SEQ ID NO:112) as well as the head-to-tail homodimer (Z$_{Aβ3A12}$)$_2$ (SEQ ID NO:113), in which eleven N-terminal amino acid residues were truncated, were included in the analysis for comparison. The experiment was carried out in duplicates on different days using freshly prepared solutions.

Results 37 candidates, isolated from the libraries as described in Example 2, were individually subjected to flow-cytometric analysis to screen for the highest Aβ binding signals. In total, 19 variants from ZASlib (ABPP001, 005, 009, 013, 014, 016, 020, 021, 025, 026, 028, 033, 035, 037, 040, 042, 048, 049 and 050, respectively) and 17 from ZSYMlib (ABPP053, 054, 059, 060, 061, 062, 070, 075, 078, 084, 089, 090, 095, 096, 097, 100 and 104, respectively), appearing multiple times in the sequence analysis, as well as the variant ABPP018 (SEQ ID NO:18) from the asymmetric library containing a longer linker, were included in the assay. Recombinant bacteria were incubated with 1 nM biotinylated Aβ$_{1-40}$ and secondary reagents as described above. The samples were subsequently analyzed for Aβ peptide binding in a flow cytometer, and the ratio of the signal from Aβ peptide binding to the signal from surface expression level (FL-2/FL-6) was determined. The head-to-tail homodimer of Z$_{Aβ3}$ with an N-terminal truncation (Z$_{Aβ3A12}$)$_2$ (SEQ ID NO: 113) was included in the analysis for comparison. All variants demonstrated higher binding-signals than the control, indicating an improved affinity for the Aβ peptide.

Example 4

On-Cell Off-Rate Ranking and Determination of Binding

Summary

In this Example, the 37 polypeptide variants expressed on the staphylococcal cell surface and studied in Example 3, were ranked based on their affinity for Aβ peptide as measured by their off-rate.

Materials and Methods

Individual staphylococcal clones (ABPP001, 005, 009, 013, 014, 016, 018, 020, 021, 025, 026, 028, 033, 035, 037, 040, 042, 048, 049, 050, 053, 054, 059, 060, 061, 062, 070, 075, 078, 084, 089, 090, 095, 096, 097, 100 and 104) were inoculated to TSB+Y with chloramphenicol (10 μg/ml) and grown overnight at 37° C. and 150 rpm. 10$^6$ cells were cultured overnight, pelleted by centrifugation and washed in PBSP before resuspension in 100 nM unlabeled Aβ$_{1-40}$ in PBSP. After 6 h incubation at room temperature with gentle mixing, cells were washed with ice-cold PBSP and incubated with 25 nM C-terminally biotinylated Aβ$_{1-40}$ peptide (AnaSpec) in PBSP at room temperature for 45 min. Subsequently, cells were washed with ice-cold PBSP and labeled with SAPE and HSA-Alexa Fluor 647 for 30 minutes on ice. The cells were washed and resuspended in ice-cold PBSP, prior to flow-cytometric analysis. The mean fluorescence intensities (MFI) from Aβ$_{1-40}$ binding and cell surface expression were measured in a Gallios flow cytometer (Beckman Coulter). The head-to-tail homodimer (Z$_{Aβ3A12}$)$_2$ (SEQ ID NO:113) was included in the analysis for comparison. The experiment was carried out in duplicates on different days using freshly prepared solutions.

Results

Figure 6:
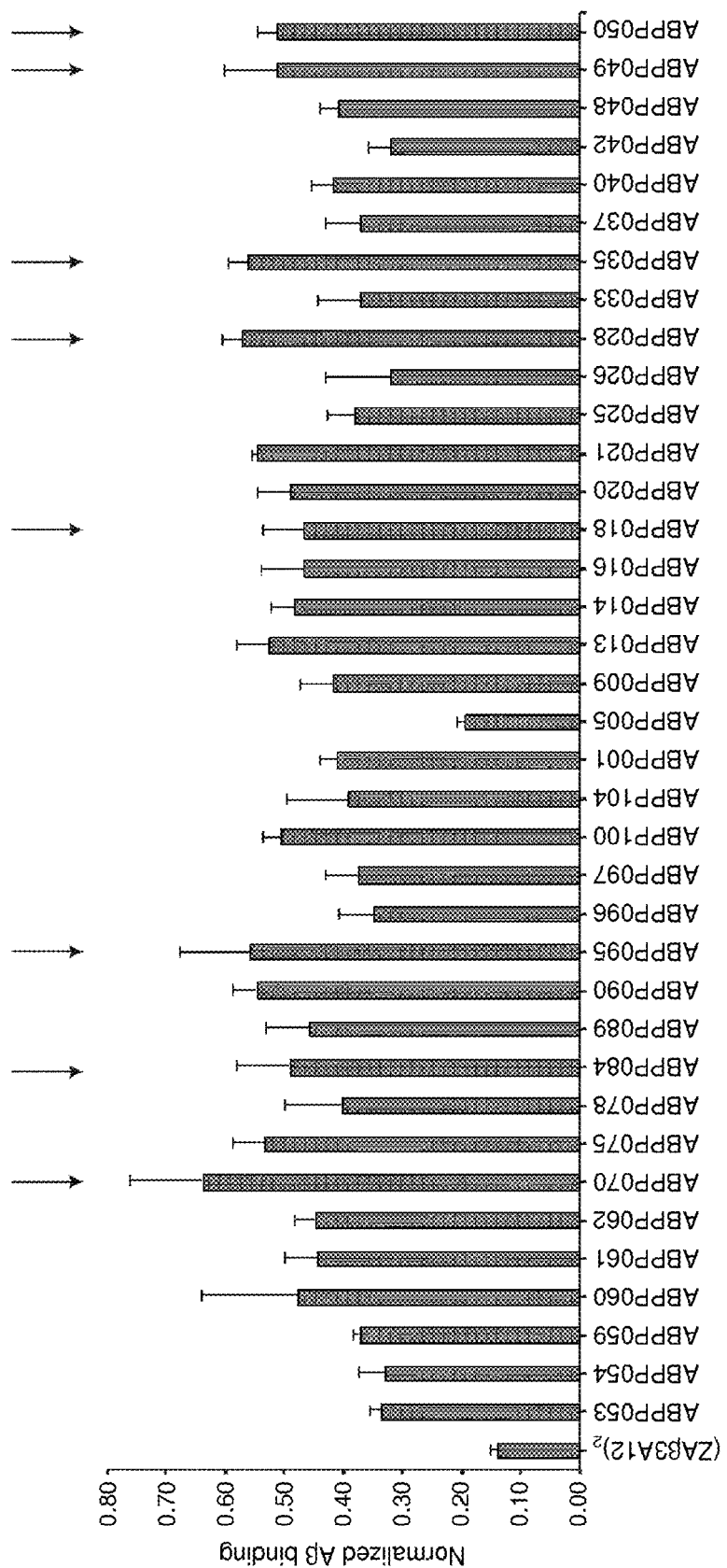
FIG. 6 shows bar graphs of the results from flow-cytometric analysis of on-cell off-rate ranking of $(Z_{A\beta3A12})_2$ (SEQ ID NO: 113) and 37 of the unique affinity matured Aβ peptide binding polypeptides isolated by FACS (ABPP001, 005, 009, 013, 014, 016, 018, 020, 021, 025, 026, 028, 033, 035, 037, 040, 042, 048, 049, 050, 053, 054, 059, 060, 061, 062, 070, 075, 078, 084, 089, 090, 095, 096, 097, 100 and 104). The Aβ peptide binding polypeptide variants are represented on the X axis, and the ratio between the mean fluorescence intensity (MFI) corresponding to Aβ peptide binding and MFI corresponding to surface expression level is represented on the Y axis. The arrowheads indicate the eight clones selected for further characterization.

In order to limit the number of Aβ peptide binding variants for further analysis, the 37 unique clones were ranked by off-rate measurements while expressed on the staphylococcal cell surface. After incubation of binding variants with biotinylated Aβ$_{1-40}$, unlabeled Aβ peptide was added in 4-fold excess and dissociation was allowed. Then, the ratio between Aβ peptide binding and surface expression level was determined (FL-2/FL-6). All clones demonstrated considerably slower dissociation from the Aβ peptide compared to (Z$_{Aβ3A12}$)$_2$ (SEQ ID NO:113) (FIG. 6). Eight variants were chosen for further study (ABPP070, 084, 095, 018, 028, 035, 049 and 050 corresponding to SEQ ID NO:70, 84, 95, 18, 28, 35, 49 and 50, respectively). Four of these demonstrated the highest Aβ binding from affinity screening, whereas four others exhibited the best off-rate. The selected clones are indicated by arrows in FIG. 6.

Example 5

Expression and Purification of Soluble Aβ Peptide Binding Polypeptides

Summary

In this Example, the eight polypeptides selected in Example 4, i.e. ABPP070, 084, 095, 018, 028, 035, 049 and 050, were expressed and purified by immobilized metal ion affinity chromatography (IMAC).

Materials and Methods

Eight affinity maturated Aβ binding polypeptides and (Z$_{Aβ3A12}$)$_2$ (SEQ ID NO: 113) were produced and purified for further characterization. The DNA sequences encoding the polypeptides were amplified from colonies by PCR, using primers that introduced an upstream NdeI and downstream XhoI restriction site. The DNA sequences were subsequently subcloned into the NdeI and XhoI digested expression vector pET26b+ (Novagen), generating constructs with a C-terminal His$_6$ tag. The plasmids were transformed into BL21 E. coli cells by heat shock. Cells were cultured in TSB at 37° C. and when OD$_{600}$ reached approximately 1, expression was induced by addition of IPTG to a final concentration of 1 mM. After overnight incubation at 25° C., the cells were harvested by centrifugation (4000 rpm, 8 minutes, 4° C.). Cells were then lysed by sonication and cell debris was removed by centrifugation (16,000 rpm, 20 minutes, 4° C.). Aβ peptide binding polypeptides were purified by IMAC using a HisPur™ Cobalt resin (Thermo Scientific) under native conditions (wash buffer: 20 mM NaHPO$_4$, 300 mM NaCl, 15 mM imidazole, pH 7.4, 0.45 μm filtered; elution buffer: 20 mM NaHPO$_4$, 300 mM NaCl, 150 mM imidazole, pH 7.4, 0.45 μm filtered). Next, potential multimers were removed by size exclusion chromatography (SEC) on an ÄKTAexplorer 10 using a Superdex 75 gel filtration column (GE Healthcare) and PBS as running buffer. The molecular weight and purity of the Aβ peptide binding polypeptides were subsequently verified by LC/MS (Agilent Technologies 6520 ESI-Q-TOF) and SDS-PAGE under both reducing and non-reducing conditions. The protein concentration was determined by absorbance measurement at 280 nm.

Results

Figure 7:
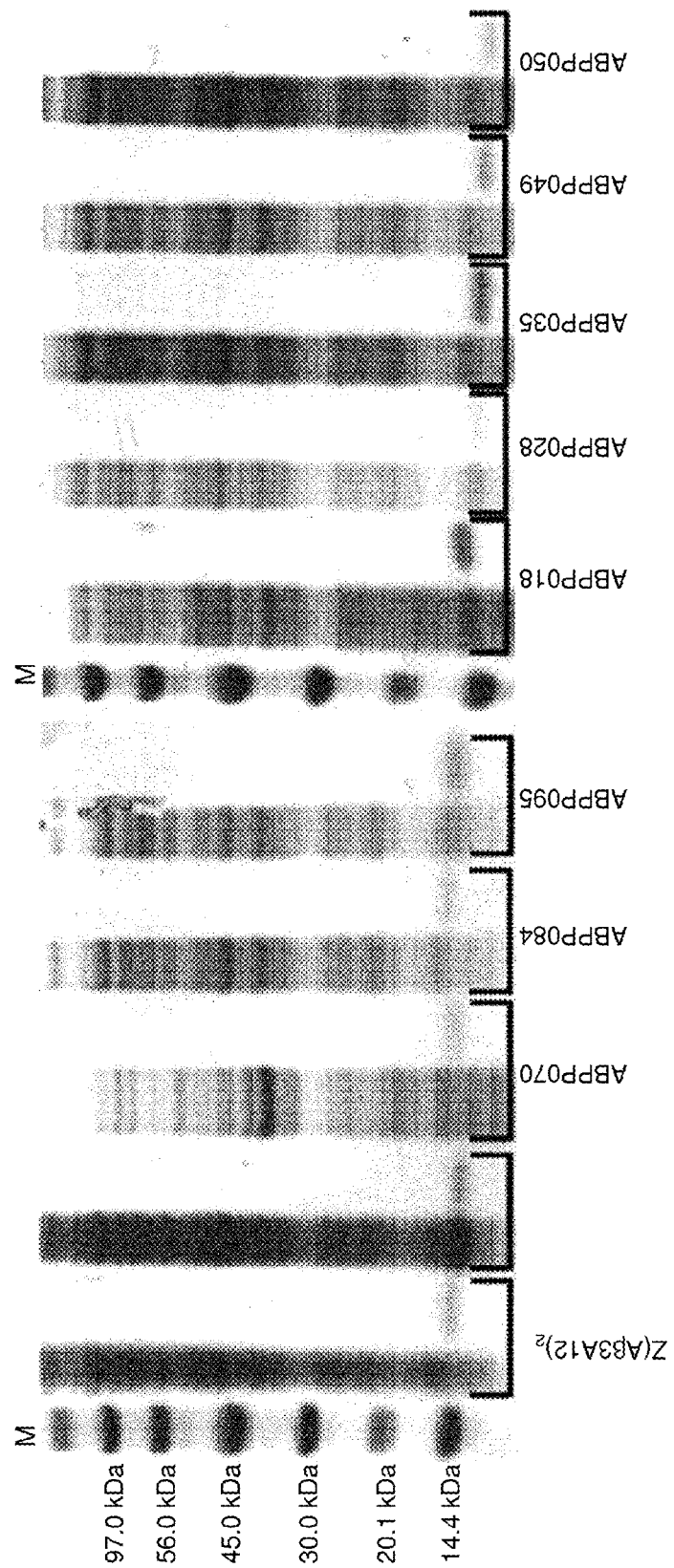
FIG. 7 shows an SDS-PAGE gel of cell lysates after SEC purification of the eight selected Aβ peptide binding polypeptides (ABPP070, 084 and 095 corresponding to SEQ ID NO:70, 84 and 95, respectively, as well as ABPP018, 028, 035, 049 and 050 corresponding to SEQ ID NO:18, 28, 35, 49 and 50, respectively) as well as of $(Z_{A\beta3A12})_2$ (SEQ ID NO:113). All purified Aβ peptide binding polypeptides showed a correct size of approximately 14 kDa as estimated from the gel. M indicates lanes with the size marker.

Eight Aβ peptide binding polypeptides (ABPP070, 084, 095, 018, 028, 035, 049 and 050, corresponding to SEQ ID NO:70, 84, 95, 18, 28, 35, 49 and 50, respectively) from the on-cell ranking were subcloned to an expression vector and produced in E. coli as C-terminally His$_6$ tagged polypeptides. The polypeptides were purified by IMAC followed by SEC to remove potential multimeric complexes. SDS-PAGE analysis of the eluted fractions under both reducing and oxidizing conditions demonstrated pure proteins having the correct size of approximately 14 kDa (FIG. 7).

Example 6

Characterization of Aβ Peptide Binding Polypeptides

Summary

In this Example, the affinity for Aβ peptide of the polypeptides expressed in Example 5, i.e. ABPP070, 084, 095, 018, 028, 035, 049 and 050, was analyzed using surface plasmon resonance (SPR) and ABPP095 was further characterized by circular dichroism (CD) spectroscopy.

Materials and Methods

Biosensor Analysis of Off-Rate and Affinity:

The affinities of the purified Aβ peptide binding polypeptides were determined using an SPR-based biosensor assay on a ProteOn XPR36 instrument (Bio Rad Laboratories, CA, USA). N-terminally biotinylated $Aβ_{1-40}$ peptide (AnaSpec) was injected over a Neutravidin sensor chip (Bio Rad Laboratories) for immobilization (immobilization levels were approximately 50 RU). Duplicate samples of each polypeptide were injected at concentrations ranging from 6.25 nM to 50 nM over immobilized Aβ peptides. The flow rate was 50 μl/min and the association and dissociation was followed for 300 seconds and 2 hours, respectively. HBS-EP was used as running buffer and 0.5% SDS was used for regeneration. In all experiments, subtraction of responses from each sample over a blank surface was performed to minimize buffer contributions. The on and off rates were determined by non-linear regression to a Langmuir 1:1 model using the Proteon Manager Software (BioRad Laboratories).

Circular Dichroism Spectroscopy:

The secondary structure content of the affinity-matured Aβ peptide binding polypeptide ABPP095 (SEQ ID NO:95) was analyzed at a concentration of 0.2 mg/ml by CD spectroscopy using a Jasco J-810 spectropolarimeter (Jasco Scandinavia AB, Molndal, Sweden) in a cell with an optical path-length of 1 mm. The thermal stability was measured at 221 nm while heating ABPP095 from 20 to 90° C. (5° C./min). A CD spectrum at 250-195 nm was obtained at 20° C. before and after heating to 90° C.

Results

Figure 8:
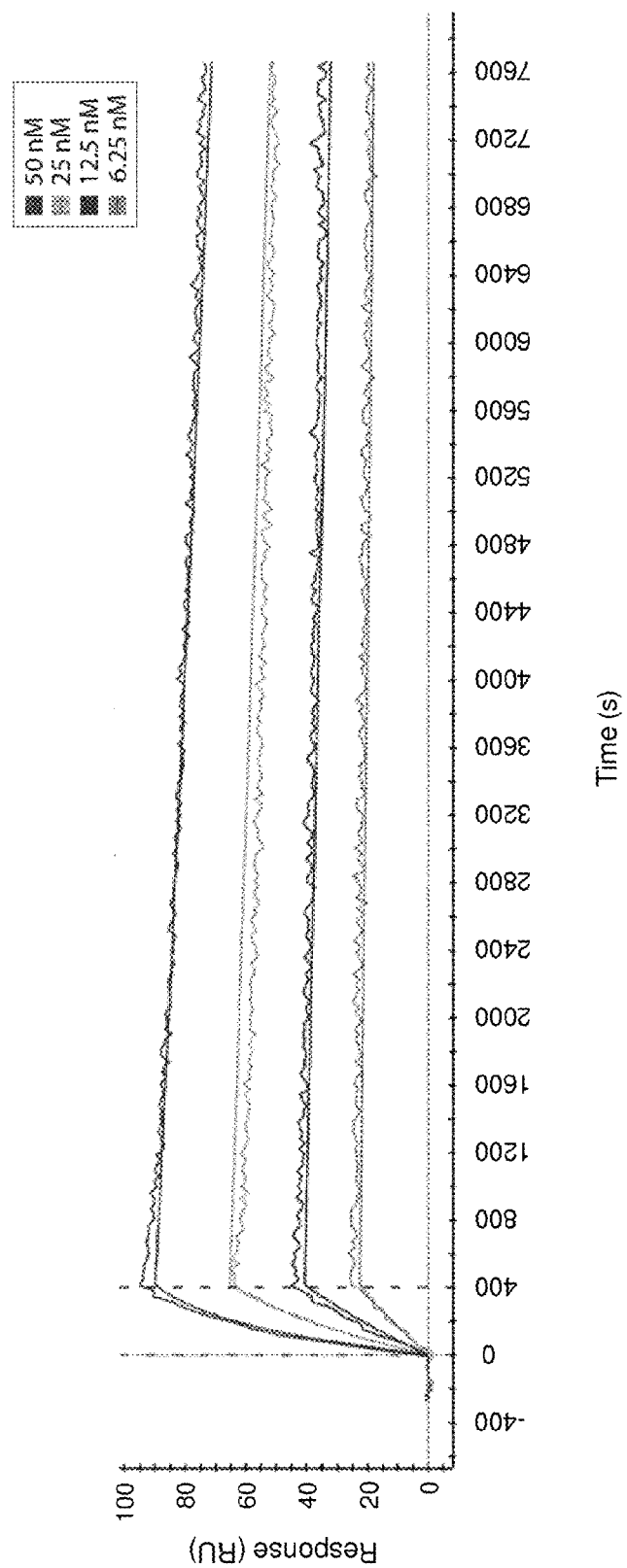
FIG. 8 shows a sensorgram obtained from affinity measurements of ABPP095 (SEQ ID NO:95) to biotinylated $A\beta_{1-40}$ on a neutravidin sensor chip using surface plasmon resonance (SPR) analysis.

Biosensor Analysis of Off-Rate and Affinity:

The eight purified Aβ peptide binding polypeptides were subjected to affinity and off-rate determination using an SPR-based biosensor assay (Table 4). A dilution series of four different concentrations of each binder was injected over a Neutravidin chip surface with immobilized biotinylated Aβ peptides. The rate constants of the interactions were determined for all candidates by non-linear regression using a one-site binding model and then used for calculation of $K_D$ values. ABPP095 demonstrated the highest affinity to $Aβ_{1-40}$, exhibiting an approximate dissociation constant $K_D$ of 340 pM, corresponding to a 50-fold improved affinity as compared to the reported 17 nM affinity for the first-generation binder (Hoyer, 2008, supra). Dissociation was followed during 2 h, and the off-rate for ABPP095 was determined to $3.2 \times 10^{-5}$ s$^{-1}$ (FIG. 8).

TABLE 4

Mean kinetic data for binding to Aβ peptide

| SEQ ID NO: | $K_D$ (M, mean ± SD)[1] | $k_a$ ($M^{-1}s^{-1}$, mean ± SD)[1] | $k_d$ ($s^{-1}$, mean ± SD)[1] |
|---|---|---|---|
| ABPP070[2] | 70 | 5.9 × 10$^{-10}$ ± 0.4 | 7.2 × 10$^4$ ± 0.6 | 4.2 × 10$^{-5}$ ± 0.05 |
| ABPP084 | 84 | 1.4 × 10$^{-9}$ ± 1.4 | 1.1 × 10$^5$ ± 0.9 | 1.5 × 10$^{-4}$ ± 0.04 |
| ABPP095[2] | 95 | 3.4 × 10$^{-10}$ ± 0.0 | 9.4 × 10$^4$ ± 0.2 | 3.2 × 10$^{-5}$ ± 0.04 |
| ABPP018 | 18 | 9.7 × 10$^{-10}$ ± 0.0 | 9.1 × 10$^4$ ± 0.3 | 8.8 × 10$^{-5}$ ± 0.02 |
| ABPP028 | 28 | 1.02 × 10$^{-9}$ ± 0.1 | 8.8 × 10$^4$ ± 0.6 | 9.0 × 10$^{-5}$ ± 0.04 |
| ABPP035 | 35 | 2.6 × 10$^{-9}$ ± 0.9 | 2.8 × 10$^4$ ± 0.9 | 6.7 × 10$^{-5}$ ± 0.09 |
| ABPP049 | 49 | 1.15 × 10$^{-9}$ ± 0.0 | 1.3 × 10$^5$ ± 0.2 | 1.5 × 10$^{-4}$ ± 0.01 |
| ABPP050 | 50 | 6.9 × 10$^{-9}$ ± 6.1 | 1.6 × 10$^3$ ± 1.3 | 7.1 × 10$^{-5}$ ± 0.40 |

Figure 9:
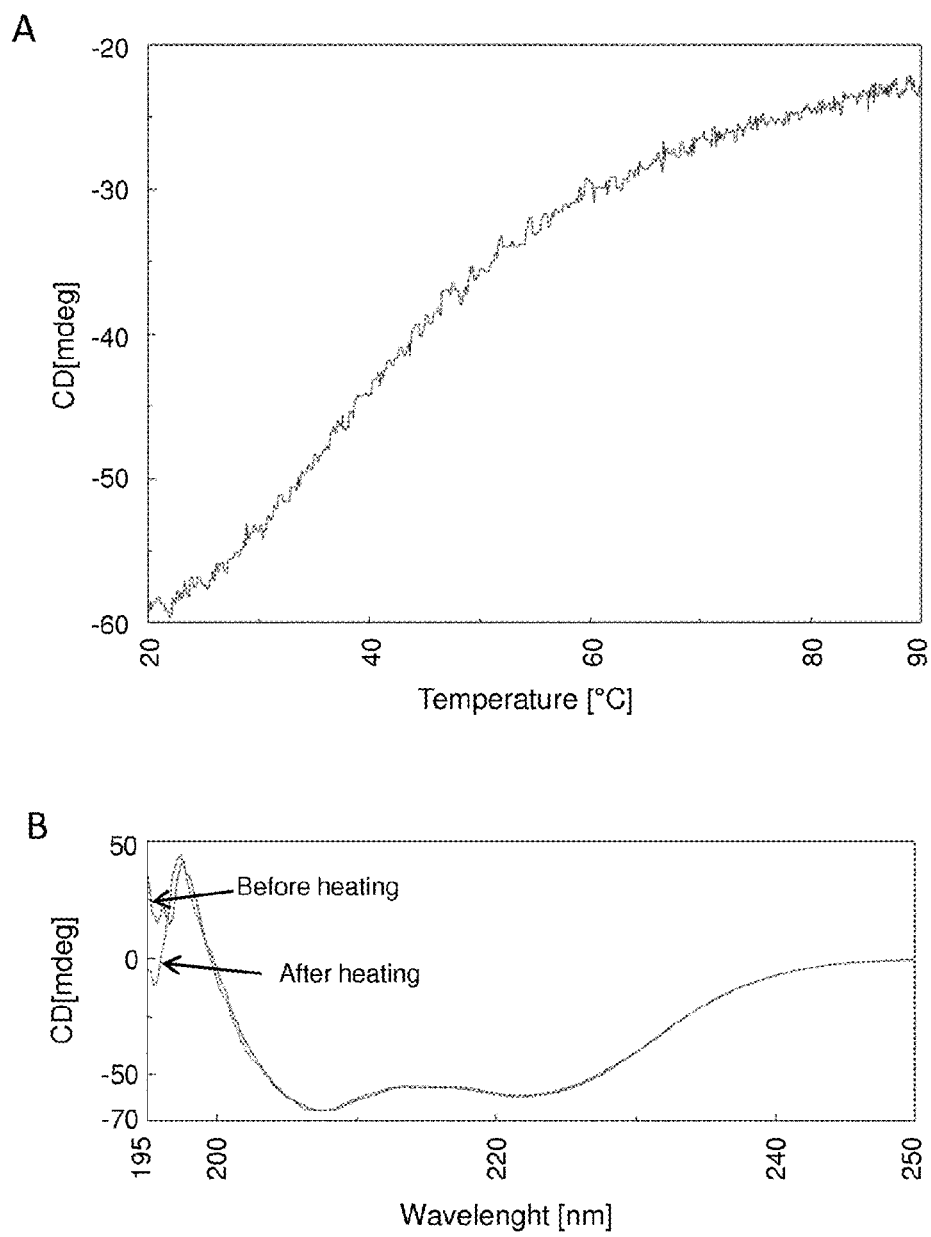
FIG. 9 shows circular dichroism (CD) spectra of ABPP095 (SEQ ID NO:95). Panel A shows a graph of a variable temperature measurement (VTM) spectrum obtained at 221 nm while heating ABPP095 from 20 to 90° C. Panel B shows CD spectra of ABPP095 at wavelengths ranging from 195 to 250 nm at 20° C., before and after variable temperature measurement (VTM).

[1]Analyzed in duplicates
[2]7600 seconds' dissociation in biosensor experiments Circular Dichroism Spectroscopy:

To further characterize the Aβ peptide binding polypeptide with the highest affinity (ABPP095), its thermal stability and secondary structure content was analyzed with circular dichroism spectroscopy. The analysis indicated that the Aβ peptide binding polypeptide had retained a similar secondary structure as the first-generation binder (Hoyer et al (2008), supra). To determine the thermal stability of the polypeptide, the sample was heated from 20 to 90° C., while monitoring the helical content, resulting in a Tm value of approximately 43° C. (FIG. 9A), which is similar to the original variant $Z_{Aβ3}$ (Hoyer et al (2008), supra). Additionally, a CD spectrum was obtained after the variable temperature measurement in order to assess the reversibility of unfolding after heat treatment. The spectrum revealed a perfect overlap with the spectrum from the unheated sample, suggesting that ABPP095 refolded completely after heating to 90° C. (FIG. 9B).

Example 7

Capture of Aβ Peptide from Spiked E. coli Lysate

Summary

In this Example, the ability of ABPP095 (SEQ ID NO:95) to capture Aβ peptide in a complex solution was studied using affinity analysis.

Materials and Methods

ABPP095 was genetically fused on the C-terminal via a 10 amino acid flexible linker to a 46 amino acid albumin binding domain denoted PP013 (SEQ ID NO:107). Genes were ligated into a PET based expression vector under the control of the T7 promoter and containing a gene for kanamycin resistance. DNA sequence verification, plasmid preparation and cultivation were done essentially as described above. Protein purification was performed essentially as previously described (Jonsson et al (2008) Prot Eng Des Sel 21(8):515-527), but the affinity chromatography matrix was equipped with an anti-[albumin binding domain] ligand (produced in house) instead of human serum albumin.

700 μg of ABPP095-PP013 (SEQ ID NO:115) was non-covalently coupled to 1 ml HSA-Sepharose 4 fast flow (GE Healthcare, Uppsala, Sweden) by batch binding at room temperature for 20 min with gentle mixing. HSA-Sepharose samples with bound polypeptides were then incubated with PBS spiked with 50 μg/ml Aβ$_{1-42}$ peptide for 1.5 h with gentle mixing. Sepharose was pelleted by centrifugation and washed with 50 ml PBS prior to elution (0.3 M HAc, pH 2.8) of captured Aβ$_{1-42}$ peptide from the HSA-Sepharose. Eluates were lyophilized using SpeedVac (Savant Instruments, Milford, Mass., USA) and dissolved in reducing sample buffer (20 mM Tris-HCl pH 8.0, 1 mM EDTA, 2.5% SDS, 5% β-mercaptoethanol, 0.01% BFB). The samples were heated at 96° C. for 10 min and loaded onto a 12% bis-Tris NuPAGE gel (Invitrogen, Carlsbad, Calif., USA) using MES running buffer (50 mM MES, 50 mM Tris base, 0.1 SDS, 1 mM EDTA, pH 7.3). Molecular weights were estimated using SeaBlue2 Pre-stained marker (Invitrogen). The gel was stained by silver stain (SilverXpress® Silver Staining Kit, Invitrogen), according to the manufacturer's instructions.

Results

Figure 10:
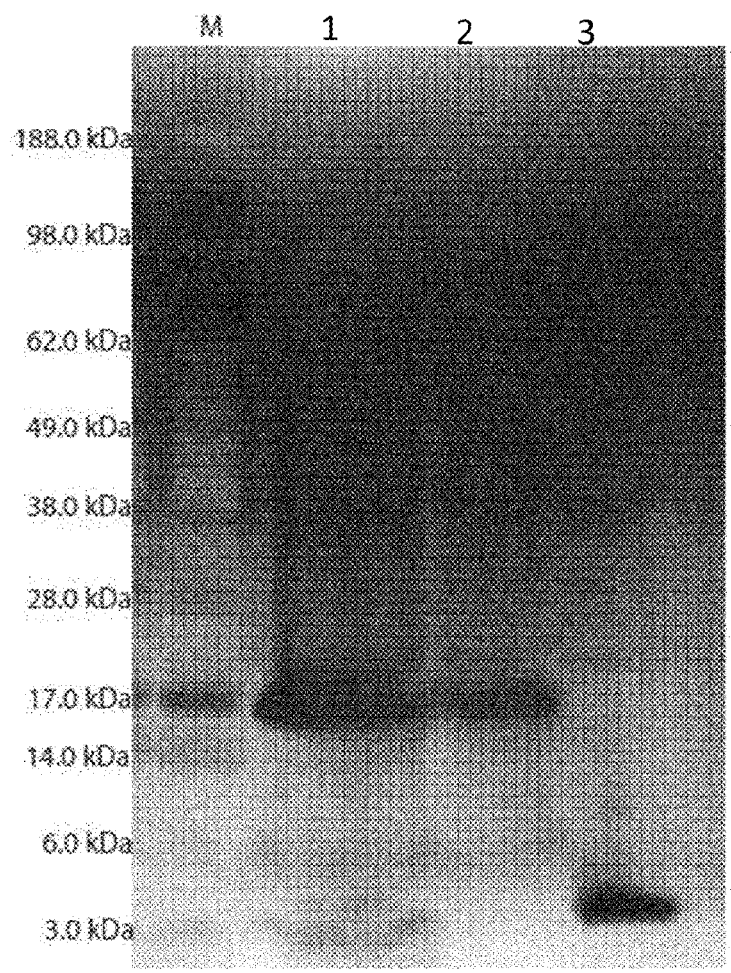
FIG. 10 shows the results from SDS-PAGE analysis of protein fractions from ABPP095-PP013 (SEQ ID NO: 115) mediated capture of Aβ peptide from PBS spiked with 50 pg/ml $A\beta_{1-42}$. The gel was silver stained for visualization of protein bands. Lane M, molecular weight marker; lane 1, eluate from [HSA Sepharose/ABPP095-PP013] incubated with $A\beta_{1-42}$ peptide; lane 2, reference ABPP095-PP013; lane 3, reference $A\beta_{1-42}$ peptide.

The ability of ABPP095-PP013 (SEQ ID NO:115) to capture Aβ peptide was studied using affinity analysis. It is likely that the potency of the Aβ peptide binding polypeptide would benefit from a long in vivo half-life, and it has previously been demonstrated that fusion of molecules to an albumin binding domain dramatically improves the time in circulation by binding to serum albumin (Andersen et al (2011) J Biol Chem 286(7):5234-5241; Orlova et al (2013) J Nucl Med 54(6):961-968). ABPP095 was therefore fused to PP013, and the assay was designed to assess whether the polypeptide could capture Aβ while simultaneously interacting with albumin. ABPP095-PP013 was first bound to HSA-Sepharose and then incubated with PBS containing Aβ$_{1-42}$ (50 μg/ml). This concentration of Aβ$_{1-42}$ peptides was chosen to reflect physiological levels of Aβ$_{1-42}$ peptides in the blood, although levels have been reported to vary significantly between patients (Kou et al (2000), supra; Du et al (2005), supra; Pesini et al (2012), supra). SDS-PAGE analysis of the elutate from the capture demonstrated that ABPP095 was capable of efficient and selective capture of Aβ$_{1-42}$ peptides (FIG. 10). Higher molecular range bands in the eluate were probably due to unspecific binding of proteins to the HSA-Sepharose. Nevertheless, the unspecific binding did not appear to significantly affect the capacity of the Aβ peptide binding polypeptide to bind Aβ.

Example 8

Locomotor and Cognitive Testing of Alzheimer's Disease Model Mice Treated with Aβ Peptide Binding Polypeptides Summary In this Example, the sensorimotor and cognitive abilities of Alzheimer's disease model mice treated with ABPP095 (SEQ ID NO:95) fused to an albumin binding domain is compared to Alzheimer's disease model mice treated with a dimer of the control polypeptide Z$_{Taq}$ (SEQ ID NO:108) fused to said albumin binding domain.

Materials and Methods

Protein Production:

ABPP095-PP013 (SEQ ID NO:115) and (Z$_{Taq}$)$_2$-PP013 (SEQ ID NO:116) were prepared as described in Example 7. To remove multimers, additional purification was performed by size exclusion chromatography using a HiLoad 16/60 column in an AKTA system (GE Healthcare) and PBS as running buffer. Potential residual endotoxins were removed by passing proteins through 1 ml EndoTrap columns (Hyglos) according to the supplier's recommendations. The proteins were eluted in DPBS (Gibco, Life Technologies) at a concentration of 1 mg/ml. Molecular weight and purity of the proteins were subsequently verified by LC/MS and SDS-PAGE under both reducing and non-reducing conditions. A large amount of protein (20 μg) in reduced as well as non-reduced form was loaded on the SDS-PAGE gel in order to detect potential multimers. The protein concentration was determined by absorbance measurement at 280 nm.

Treatment of Transgenic Mice:

Animal studies were approved by the New York University School of Medicine Institutional Animal Care and Use Committee and were consistent with the recommendations of the American Veterinary Association. To model vascular amyloid deposition and amyloid related pathology, the well-characterized double-transgenic (2×Tg) sweAPP/PS1 mouse model was used. The model allows expression of the APPK670N/M671L mutations ("the Swedish mutation") as well as the PS1 M146V mutation, and has an early onset of AD pathology. Twenty animals were divided into two groups and received intraperitoneal (i.p.) injections of 100 μg (in a volume of 100 μl) of ABPP095-PP013 protein or the irrelevant (Z$_{Taq}$)$_2$-PP013 protein three times per week for 13 weeks, beginning at 3-4 months of age. 10 mice were treated with ABPP095-PP013 protein and 10 mice were treated with the negative control (Z$_{Taq}$)$_2$-PP013 protein. During the treatment, veterinary staff monitored animals for any signs of toxicity, such as changes in body weight, physical appearance, and altered behavior. At 6-7 months, the mice went through extensive behavioral testing and were subsequently killed for tissue analyses at 7-8 months of age.

Behavioral Studies:

Before cognitive testing, exploratory locomotor activity and accelerating rotarod performance tests were performed, in order to measure motor coordination and balance. This was done in order to exclude that any observed effects in the performance of the cognitive tasks were due to differences in sensorimotor abilities.

Locomotor Activity:

A Hamilton-Kinder Smart-frame Photobeam System was used to record activity of the mice over a designated period of time. After habituation in a circular open field chamber (70 cm in diameter) for 15 min, each mouse was allowed to explore the environment for 15 min. Horizontal movements of the mice were automatically recorded by a video camera mounted above the chamber. After each session, the field was cleaned with water and 30% ethanol. Results were reported as distance traveled (cm), average and maximum travel velocity (cm/s) and mean resting time (s) for each animal.

Rotarod Performance:

Each animal was placed on a rod apparatus, with a rod diameter of 3.6 cm, to assess differences in motor coordination and balance (Rotarod 7650 accelerating model; Ugo Basile) between mice treated with ABPP095-PP013 protein and mice treated with (Z$_{Taq}$)$_2$-PP013 protein. The animals were habituated to the apparatus for two training trials in order to reach a baseline level of performance. The animals were subsequently tested in three additional trials with 15 minute intervening periods. The rotarod was set to an initial speed of 1.0 rpm, which was gradually raised every 30 s by 0.5 rpm. A soft foam cushion was placed under the rod to prevent injury from falling. The rod was cleaned with water and 30% ethanol after each session. To assess the performance, the total time on the rod and the speed of the rod were recorded when the mouse fell or inverted (by clinging) from the top of the rotating barrel.

Radial Arm Maze:

Spatial memory was assessed using an eight-arm radial maze with eight 30 cm long arms originating from a central space. 0.25 ml of 0.1% aqueous saccharine solution was placed at the end of each arm. In addition to (2×Tg) sweAPP/PS1 mice treated with ABPP095-PP013 and the (2×Tg) sweAPP/PS1 mice treated with $(Z_{Taq})_2$-PP013, an age-matched control group of wild type mice (n=10) was included in this experiment.

Before testing, the mice were deprived of water for 24 h and their access to water was restricted to 1-2 h per day for the duration of testing. The animal entered and exited the maze through the central area. Clear Plexiglas guillotine doors, operated by a remote pulley system, controlled access to the arms from the central area. After two days of adaptation to the maze, water restricted mice were given one training session per day for 10-11 consecutive days. Prior to each day's testing, the mice were adapted to the room with the lights on for 15 min. The animals were also adapted to the instrument and permitted to enter all arms until the eight rewards (baits containing saccharine) had been consumed. The number of errors (entry into previously visited arms) was recorded.

Statistical Analysis:

Data from the exploratory locomotor activity test, the accelerating rotarod performance test and the radial arm maze test was analyzed using two-way ANOVA, repeated measures and a Neuman Keuls (Statistica) or a Bonferroni (GraphPad, San Diego, Calif.) post hoc test.

Results

Figure 11:
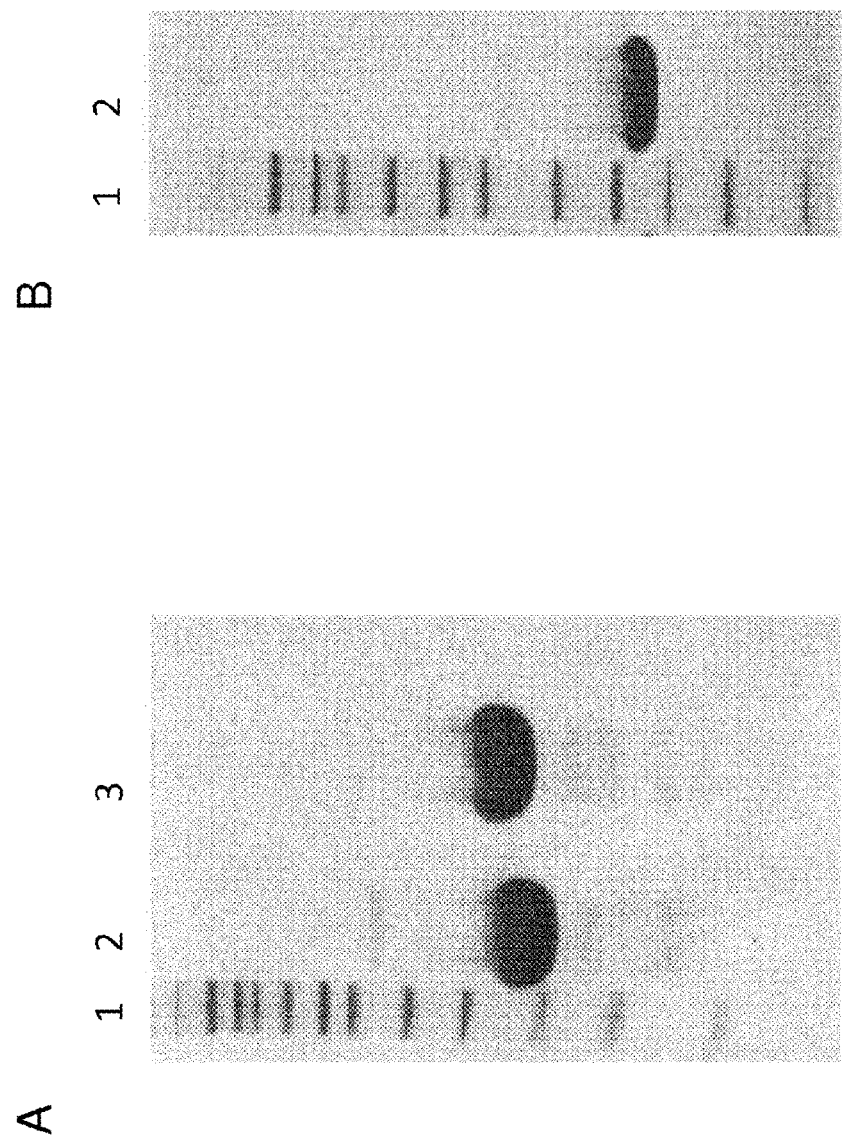
FIG. 11 shows the results from the SDS-PAGE analysis of purified ABPP095-PP013 (SEQ ID NO:115) and $(Z_{Taq})_2$-PP013 (SEQ ID NO:116), respectively. Panel A: lane 1, molecular marker; lane 2, 20 μg reduced ABPP095-PP013 protein; lane 3, 20 μg non-reduced ABPP095-PP013 protein. Panel B: lane 1, molecular marker; lane 2, 10 μg reduced $(Z_{Taq})_2$-PP013 protein.

Protein Production:

It was expected that the potency of an Aβ peptide binding polypeptide as a therapeutic agent would benefit from a long in vivo half-life. It has previously been demonstrated that fusing Z variant molecules, with affinities for other, non-related targets, to an affinity-matured albumin binding domain significantly improved the in vivo half life by binding to serum albumin. Therefore, in preparation for in vivo analysis, the high-affinity Aβ-specific ABPP095 polypeptide and a dimer of the control polypeptide $Z_{Taq}$ were subcloned and expressed in fusion with a C-terminal deimmunized high-affinity albumin binding domain PP013. A 10 amino acid linker separating the polypeptide and albumin binding domain was used. $Z_{Taq}$ was cloned as a head-to-tail dimer to mimic the format of ABPP095. Approximately 300 mg of each protein was produced and purified for in vivo studies. Multimers were removed by size exclusion chromatography and potential endotoxins were removed using EndoTrap columns. The molecular weight and purity of the proteins were verified by LC/MS and SDS-PAGE (FIG. 11) and the protein concentration was determined.

Figure 12A:
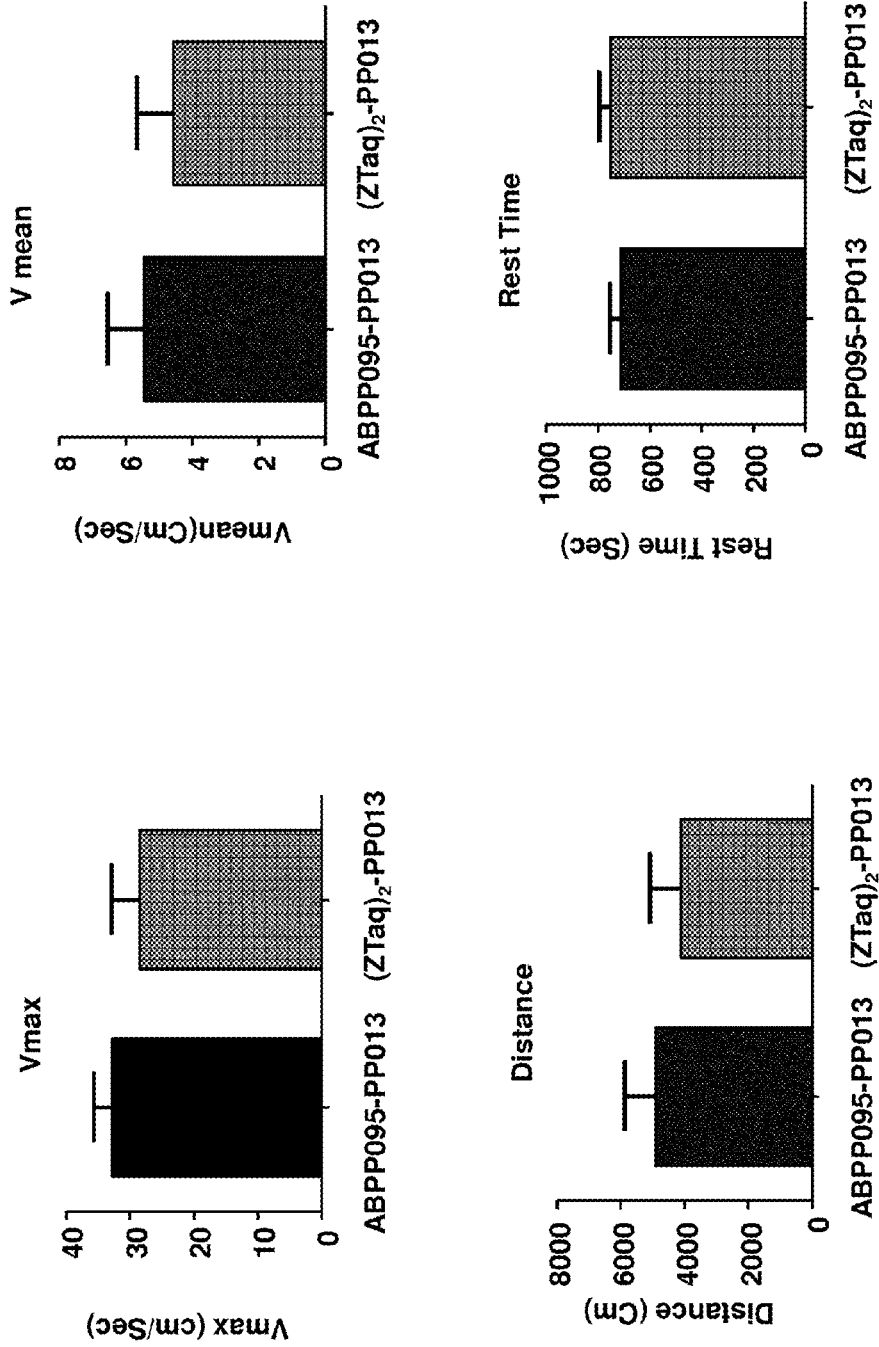

Behavioral Studies:

Groups of (2×Tg) sweAPP/PS1 mice treated with ABPP095-PP013 or with $(Z_{Taq})_2$-PP013 (control), were assessed in both cognitive and sensorimotor tests. No significant differences were observed between the groups in locomotor activity in terms of distance traveled, rest time, maximum speed, and mean velocity (FIG. 12A). In correlation with this, no difference was observed in the rotarod performance test between transgenic mice treated with ABPP095-PP013 and transgenic mice with $(Z_{Taq})_2$-PP013 (control) (FIG. 12B). Thus, the performance in the cognitive test was not confounded by the differences or abnormalities in motor function.

Figure 13:
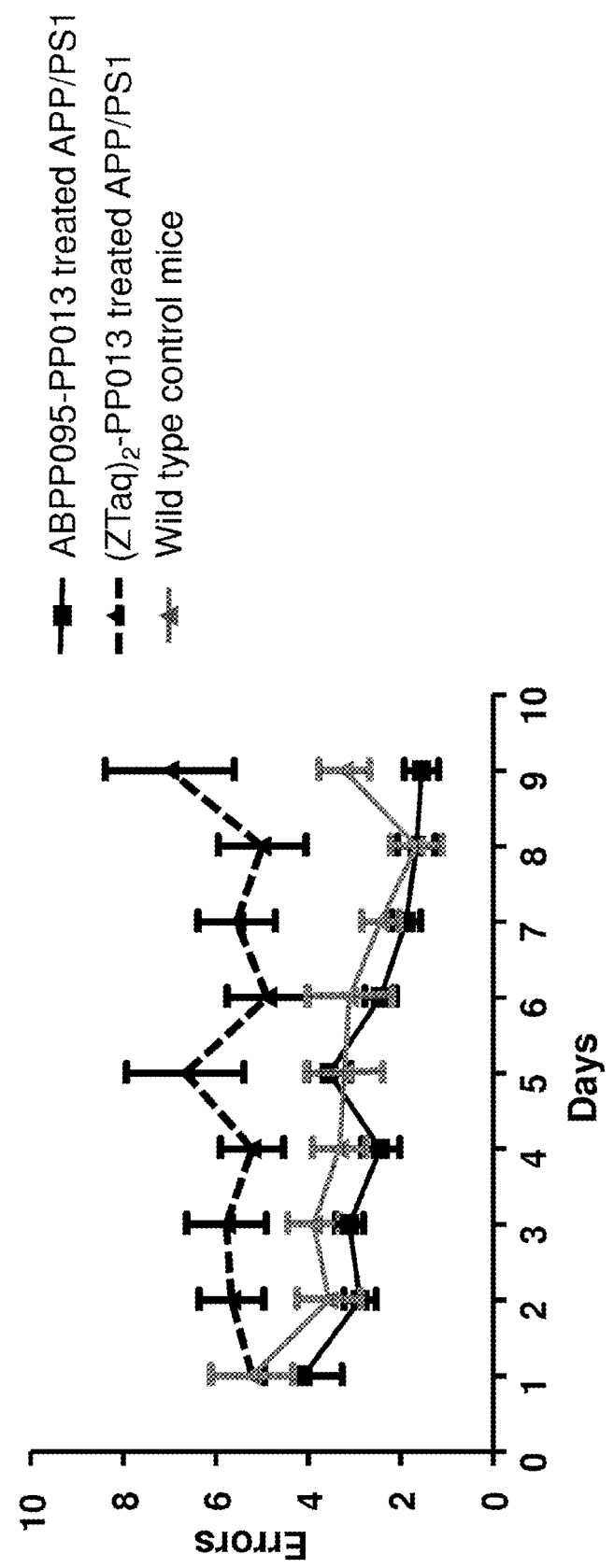
FIG. 13 shows the results from the radial arm maze test obtained from 10 (2×Tg) sweAPP/PS1 mice treated with ABPP095-PP013, 10 (2×Tg) sweAPP/PS1 mice treated with $(Z_{Taq})_2$-PP013 (control) and 10 wild type control mice. The number of errors is shown on the y-axis and the day of testing on the x-axis.

In the radial arm maze, (2×Tg) sweAPP/PS1 mice treated with ABPP095-PP013, as well as wild type mice used as control, showed a significantly better performance compared to the transgenic mice injected with control polypeptide. No differences in performance were observed between the wild-type controls and the transgenic mice treated with ABPP095-PP013 (FIG. 13). Two-way repeated measures ANOVA revealed a significant cognition improvement benefit of ABPP095-PP013 treatment as compared to injection of $(ZTaq)_2$-PP013. Thus, treatment with ABPP095-PP013 significantly improved the cognitive abilities of the transgenic Alzheimer's disease model mice as evaluated in the radial arm maze.

Example 9

Histologic Analysis of Alzheimer's Disease Model Mice Treated with Aβ Peptide Binding Polypeptide Summary This Example describes histological analyses of (2×Tg) sweAPP/PS1 mice, treated with the Aβ peptide binding polypeptide ABPP095-PP013 or control polypeptide and sacrificed after the behavioral study described in Example 8. The results demonstrated that ABPP095-PP013 substantially reduced the brain amyloid burden, and that this effect correlated with behavioral amelioration in the treated (2×Tg) sweAPP/PS1 mice.

Materials and Methods

Mice were anesthetized with sodium pentobarbital (150 mg/kg i.p.), perfused transaortically and the brains were immediately removed and processed. The right hemisphere was immersion-fixed overnight in periodate-lysine-paraformaldehyde. Following fixation, the brain was moved to a phosphate buffer solution containing 20% glycerol and 2% dimethylsulfoxide (DMSO) and stored at 4° C. until sectioned. Serial coronal brain sections (40 μm) were cut, placed in ethylene glycol cryoprotectant and stored at −20° C. until used. Sections were stained for immunohistochemical analysis with i) a mixture of the anti-Aβ3 monoclonal antibodies 6E10 and 4G8 (Covagen Research Products Inc), ii) polyclonal anti-glial fibrillary acidic protein (GFAβ) antibody (DAKO) to detect astrocytes. The staining was performed as previously described (Boutajangout et al (2009) J Alzheimers Dis18:961-72; Scholzova et al (2009) J Neuroscience 29:1846-54; Liu et al (2014) J Neurochem 128:577-91).

Amyloid burden was quantified by a Bioquant stereology image analysis system (BIOQUANT Image Analysis Corporation) using a random unbiased sampling scheme. Total Aβ burden (defined as the percentage of test area occupied by Aβ immunoreactivity) was quantified for the cortex and hippocampus on coronal plane sections stained with a mixture of the anti-Aβ3 monoclonal antibodies 6E10 and 4G8.

The assessment of sections stained with the GFAP antibody was based on a semi-quantitative analysis, using methods previously published (Yang et al (2011) J Alzheimers Dis 24:269-285; Scholtzova et al (2009) supra; Sadowski et al (2006) Proc Natl Acad Sci 103:18787-92). Prior to analysis, brains were observed through the microscope and given a rating from 0-4, in increments of 0.5, depending on the degree of pathology and/or the activation stage of the glial cells. Approximately five cortical sections and six hippocampal sections were analyzed per animal. The rating was based on the number of reactive neuronal bodies and processes. Astrogliosis was analyzed at 10× magnifications in the cortex, hippocampus and thalamus region. The rating for astrogliosis was based on the extent of GFAP immuoreactivity (number of GFAP immunoreactive cells and complexity of astrocytic branching). The rating was done by an observer blinded to the treatment status of the mice.

All statistical analyses of total amyloid burden and astrogliosis were performed using Prism 6.0 (Graphpad, San Diego, Calif., USA).

Results

Figure 14:
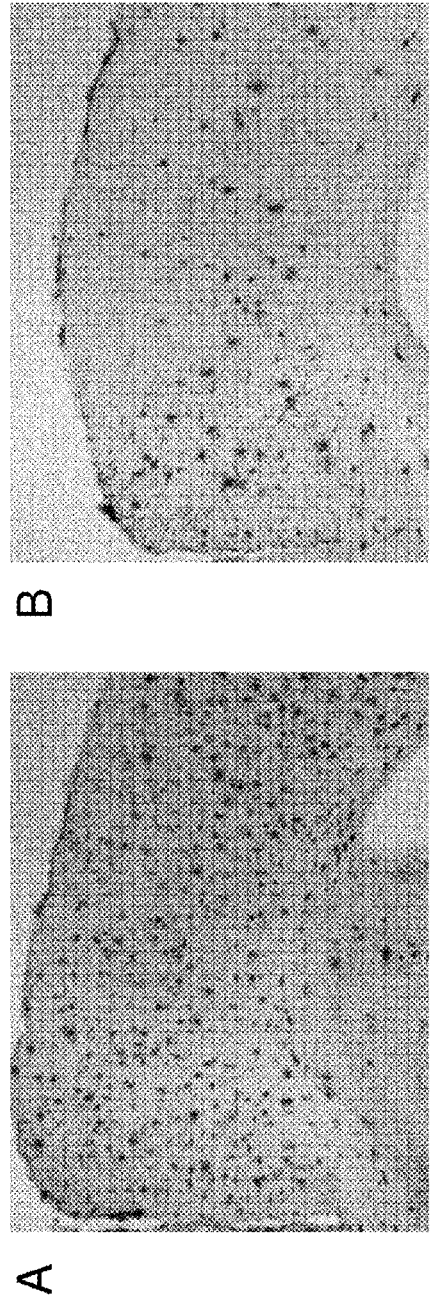
FIG. 14 shows accumulation of amyloid plaques in motor cortex of (2×Tg) sweAPP/PS1 mice. Panels A and B show representative Aβ3-immunostained (6E10/4G8) brain sections from mice treated with $(Z_{Taq})_2$-PP013 (control) and ABPP095-PP013, respectively. Panel C shows bar graphs of the histological quantification of cortical amyloid plaque burden in ABPP095-PP013 treated mice and control-treated mice.
Figure 14:
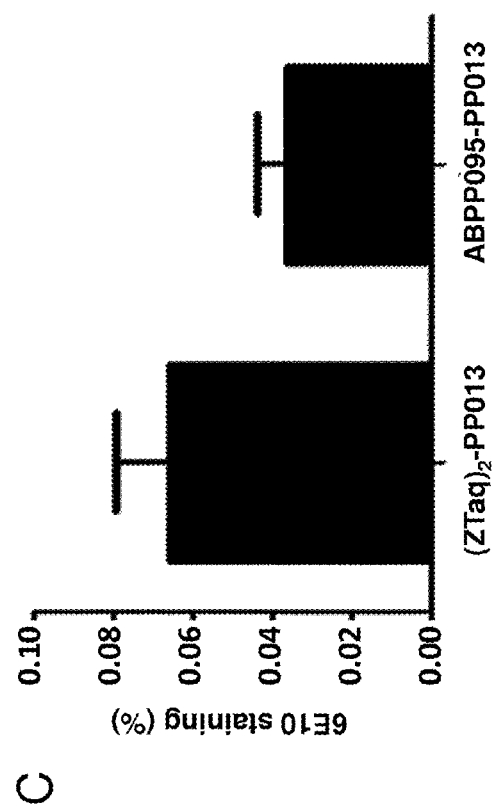
Figure 15:
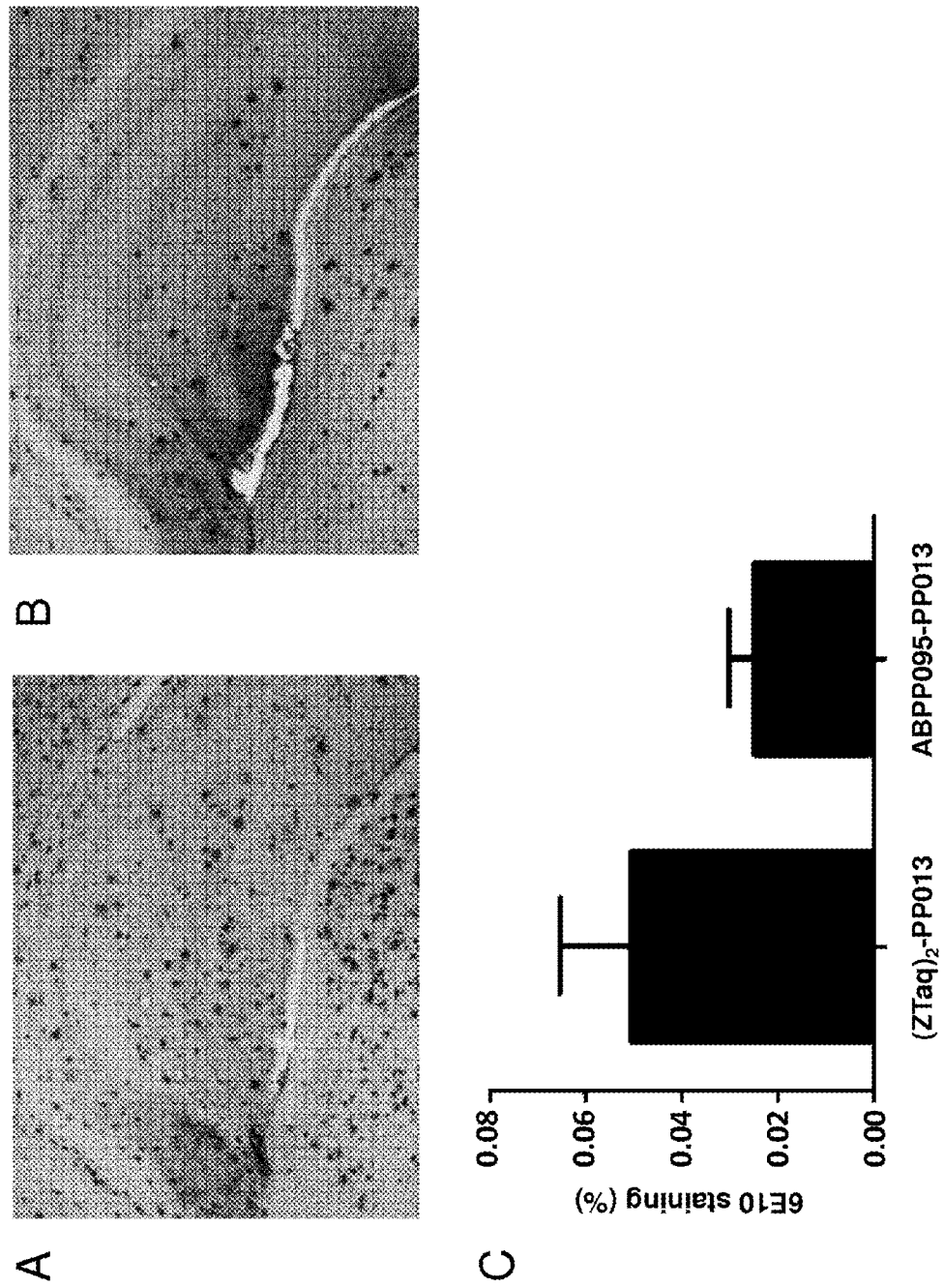
FIG. 15 shows accumulation of amyloid plaques in dentate gyrus of the hippocampus of (2×Tg) sweAPP/PS1 mice. Panels A and B show representative Aβ3-immunostained (6E10/4G8) brain sections from mice treated with $(Z_{Taq})_2$-PP013 (control) and ABPP095-PP013, respectively. Panel C shows bar graphs of the histological quantification of hippocampal amyloid plaque burden in ABPP095-PP013 treated mice and control-treated mice.

Histological Quantification of Amyloid Burden:

Total amyloid burden in the cortex and dentate gyrus of the hippocampus of ABPP095-PP013 treated mice versus $(ZTaq)_2$-PP013 (control) treated mice were quantified by stereological techniques using random unbiased sampling on the serial sections immunostained with a mixture of 6E10 and 4G8 antibodies. Aβ immunostaining showed a significant reduction in Aβ accumulation in both cortical (FIG. 14A-C) and hippocampal (FIG. 15A-C) sections of the ABPP095-PP013 treated mice compared to the control group (p=0.03 and p=0.05 in cortex and hippocampus, respectively).

Figure 16:
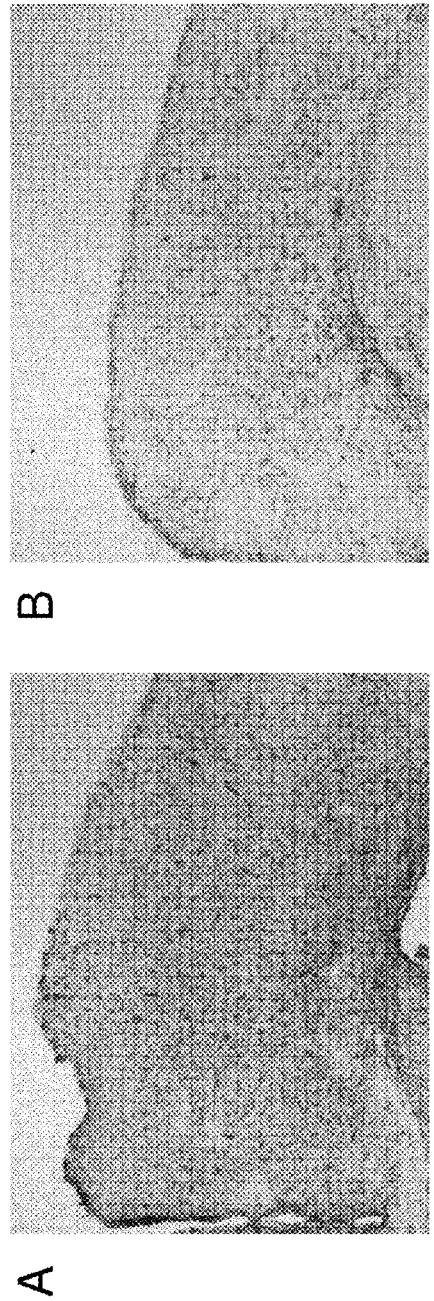
FIG. 16 shows astrogliosis in the hippocampus of (2×Tg) sweAPP/PS1 mice. Panels A and B show representative GFAβ-immunostained brain sections from mice treated with $(Z_{Taq})_2$-PP013 (control) and ABPP095-PP013, respectively. Panel C shows bar graphs of the semi-quantitative analysis of astrocytes in ABPP095-PP013 treated mice as compared to control-treated mice.
Figure 16:
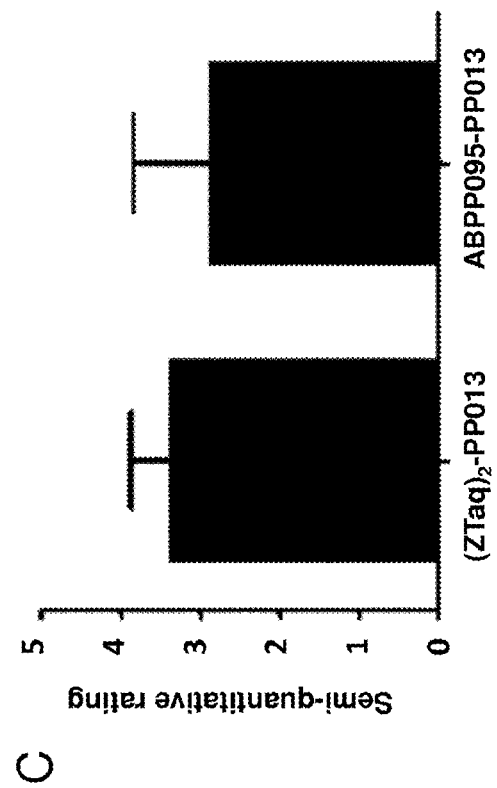

Neuroinflammatory Response after Treatment:

A concern when administrating therapeutics that target Aβ depositions is the risk of increased brain inflammation, ultimately resulting in neuronal dysfunction or death. To evaluate the effect of ABPP095-PP013 treatment on brain inflammation, the extent of gliosis in the hippocampus and cortex was quantitatively examined by immunohistochemical staining. Histological observation of astrocytes, which were stained with an anti-GFAP antibody, revealed that there was a slight reduction in astrogliosis in the ABPP095-PP013 treated mice compared to the control treated group, although the observed differences were not significant (FIG. 16A-C). Most importantly, no increased risk of brain inflammation was observed in association with ABPP095-PP013 treatment.

Example 10

Extraction of Soluble and Insoluble Aβ from Alzheimer's Disease Model Mice Treated with Aβ Peptide Binding Polypeptides Summary This Example describes the assessment of total soluble Aβ and Aβ aggregates/oligomers in the brain of (2×Tg) sweAPP/PS1 mice sacrificed after the behavioral study described in Example 8 and studied histologically as described in Example 9.

Materials and Methods

The left hemisphere of each brain was weighed and homogenized (10% w/v) in tissue homogenization buffer (20 mM Tris base, pH 7.4, 250 mM sucrose, 1 mM EDTA, 1 mM EGTA) with 100 mM phenylmethylsulphonyl fluoride, complete protease inhibitor cocktail and PhosSTOP phosphatase inhibitor cocktail (Roche) added immediately before homogenization. The extraction of soluble Aβ and total Aβ was done according to the method published previously (Boutajangout et al (2009) supra; Scholtzova et al (2009) supra; Goni et al (2010) PLoS One 5:e13391; Yang et al 2011 supra; Liu et al 2014, supra).

In brief, a first brain homogenate (200 µl) was mixed with an equal volume of cold 0.4% diethylamine (DEA)/100 mM NaCl, and subsequently centrifuged at 100000 g for 1 h at 4° C. The obtained supernatant was neutralized with ¹/₁₀ volume of 0.5 M Tris, pH 6.8, flash-frozen on dry ice and stored at −80° C. until used as soluble Aβ fraction.

A second homogenate (200 µl) was added to 440 µl of cold formic acid (FA) and sonicated for 1 min on ice. Subsequently, 400 µl of this solution was centrifuged at 100000 g for 1 h at 4° C. and 210 µl of the resulting supernatant was diluted into 4 ml of FA neutralization solution (1 M Tris base, 0.5 M $Na_2HPO_4$, 0.05% $NaN_3$), flash-frozen on dry ice and stored at −80° C. until used for total Aβ measurement.

Levels of soluble and total Aβ using DEA and FA extracts, respectively, are determined by a sandwich Enzyme-Linked Immuno Sorbent Assay (ELISA) for instance as described in Scholtzova et al (2009, supra).

Preparations of samples and measurements of levels of Aβ oligomers and Aβ aggregates in the brain are determined for example as described in Scholtzova et al (2014, Acta Neuropathologica Communications 2:101) and Liu et al 2014, supra) including western blot analysis using antibodies specific for Aβ oligomers/aggregates (for example A11 polyclonal antibody (Invitrogen)) and analysis by a Human Aggregated Aβ ELISA kit (Invitrogen) according to the manufacturer's instructions.

Results

The results are expected to show reduced levels of total and soluble Aβ as well as reduced levels of Aβ aggregates/oligomers in brains from ABPP095-PP013 treated mice compared to brains from mice treated with the control polypeptide $(ZTaq)_2$-PP013.

Example 11

Measurement of Plasma Levels of Aβ Peptide Binding Polypeptides

Summary

This Example describes the assessment of plasma levels of ABPP095-PP013 and $(ZTaq)_2$-PP013 in the (2×Tg) sweAPP/PS1 mice studied in Example 8.

Materials and Methods

The mice were bled before the commencement of the behavioral study described in Example 8 as well as periodically throughout the study. Plasma levels of ABPP095-PP013 and $(ZTaq)_2$-PP013 are detected by ELISA using plates (Immulon 2HB; Thermo Electron Corp) coated with 0.5 µg/well of $Aβ_{1-40}$ peptide (synthesized at the Keck Foundation at Yale University). Detection is performed using a primary polyclonal goat anti-Z IgG (in-house produced) at a dilution of 1/1000 and subsequently by a labeled secondary antibody, for example an anti-goat IgG-HRP (Jackson). Plates are developed with TMB substrate and the reactions are stopped with 2M $H_2SO_4$ followed by absorbance measurements at 450 nm.

Results

The results are expected to show the levels of ABPP095-PP013 and $(ZTaq)_2$-PP013 over time in plasma samples obtained from treated (2×Tg) sweAPP/PS1 mice.

Example 12

Inhibition of Aβ Aggregation by Aβ Peptide Binding Polypeptides Studied by Thioflavin Fluorescence Assay Summary In Alzheimer's disease (AD), the Aβ peptide is prone to aggregate. The course of events can be studied in vitro with methods such as the thioflavin T (ThT) fluorescence assay (Hellstrand et al (2009), ACS Chem. Neurosci. 1:13-18). This assay measures changes of in fluorescence intensity of ThT upon binding to amyloid fibrils. The enhanced fluorescence can be observed by fluorescence spectroscopy. The capacity of Aβ peptide binding polypeptides as disclosed herein to inhibit Aβ peptide aggregation is tested in the ThT assay.

Materials and Methods

Monomeric $A\beta_{1-40}$ or $A\beta_{1-42}$ at various concentrations is mixed with 20 μM ThT (Sigma) in a 20 mM sodium phosphate buffer supplemented with 200 μM EDTA. The preparation is done in black polysterene ELISA plates with clear bottom and on ice. The aggregation is triggered by placing 96 well plates at 37° C. and shaking at 100 rpm. The ThT fluorescence is measured using 440 and 480 nm excitation and emission filters, respectively, in an Enspire plate reader (Perkin Elmer). The fluorescence is initially measured over a time period to find out the optimal Aβ peptide concentration and the time needed to reach maximal aggregation. The ability of an Aβ peptide binding polypeptide as disclosed herein to block aggregation is tested by mixing the Aβ peptide binding polypeptide at various concentrations together with the optimized Aβ3:ThT ratio and then reading the fluorescence as described above.

Results

The results are expected to show that Aβ peptide binding polypeptides as disclosed herein block the aggregation of Aβ peptide in vitro as measured by the ThT aggregation assay.

Example 13

Inhibition of Aβ Aggregation by Aβ Peptide Binding Polypeptides Studied by Fluorescence Correlation Spectroscopy (FCS)

Materials and Methods

Sample Preparation:

$A\beta_{40}$ (AlexoTech AB, Umea, Sweden) was freshly prepared by dissolving the peptide powder on ice in 10 mM NaOH to a concentration of 1.0 mg/ml, followed by dilution in 20 mM HEPES, pH 7.0 as required. Fluorescently labeled opioid peptides, custom synthesized and purified >98% (Biomatik), were added to the freshly prepared solution of unlabeled $A\beta_{40}$ and the concentration was confirmed by FCS immediately after mixing. The time course of $A\beta_{40}$ aggregation was monitored in a solution containing 10 μM unlabeled $A\beta_{40}$, 100 nM $A\beta_{40}$-Alexa488 and 100 nM $A\beta_{40}$-Alexa647 in 20 mM HEPES, pH 7.0, T=20° C. in the presence or absence of 20 μM of the Aβ binding polypeptide ABPP095 (SEQ ID NO:95).

FCS Measurements:

FCS measurements were performed on a uniquely modified ConfoCor3 instrument (Carl Zeiss, Jena, Germany) consisting of an inverted microscope for transmitted light and epifluorescence (Axiovert 200 M); a VIS-laser module comprising the Ar/ArKr (458, 477, 488 and 514 nm), HeNe 543 nm and HeNe 633 nm lasers; and the scanning module LSM 510 META. The instrument was modified to enable detection using silicon Avalanche Photo Detectors (SPCM-AQR-1X; PerkinElmer, USA) for imaging and FCS (Vukojevic et al (2008), Proc Natl Acad Sci 105:18176-18181). The C-Apochromat 40×, NA=1.2, water immersion UV-VIS-IR objective was used throughout. Alexa488 was excited using the 488 nm line of the Ar/ArKr laser, whereas the HeNe633 laser was used to excite Alexa647. The main dichroic beam splitter HFT 488/543/633 was used to separate the incident and fluorescence light. Fluorescence signals were separated using a secondary dichroic beam splitter (NFT 635) and further spectrally narrowed before detection using a band pass filter (BP 505-610) for Alexa488 and a long pass filter (LP 650) for Alexa647.

Fluorescence intensity fluctuations were recorded at approximately 10 min intervals in arrays of 30 consecutive measurements, each measurement lasting 10 s, and analyzed by temporal autocorrelation analysis. Autocorrelation curves were analyzed using the online software for data analysis and the generated autocorrelation curves were fitted with a model for free 3D diffusion of one component. Fitting was performed using the dedicated routine that is part of the running software and the quality of fitting was evaluated by residuals analysis.

Results

Figure 17:
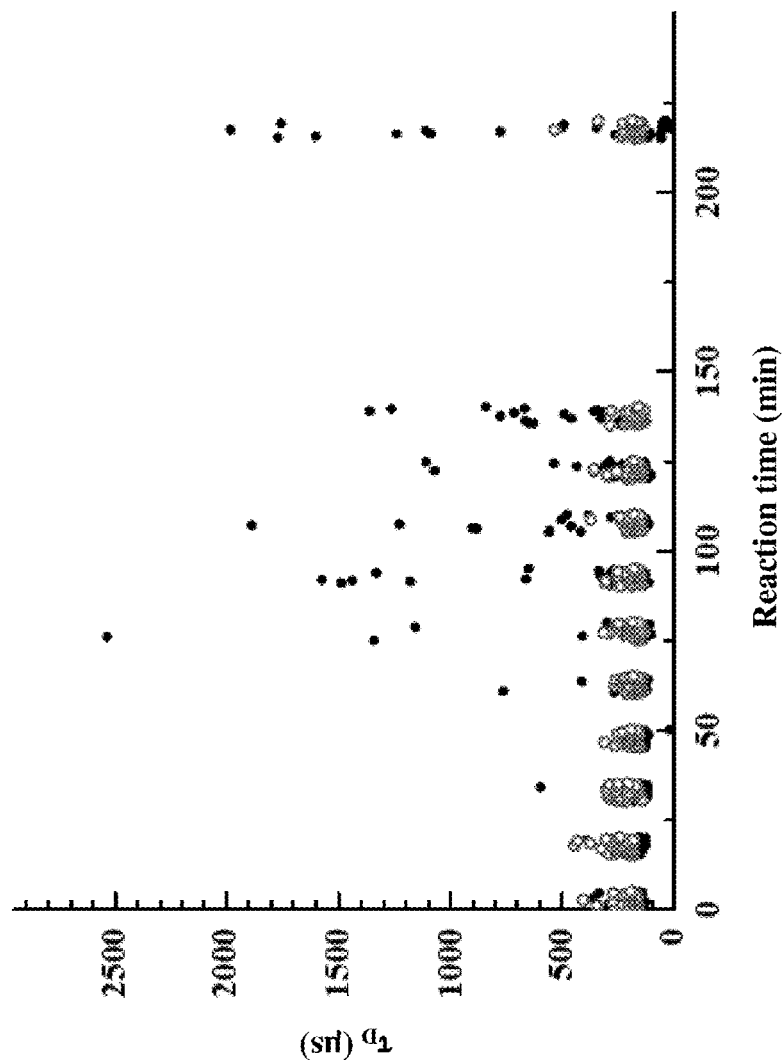
FIG. 17 shows a diffusion time analysis by fluorescence correlation spectroscopy. The diffusion time ($T_D$), reflecting the size of the analyzed component, is presented over time for Alexa467-labeled $A\beta_{1-40}$ peptide in the absence (black dots) and presence (grey rings) of ABPP095.

Fluorescence correlation spectroscopy was applied to study $A\beta_4o$ aggregation in solution over time, in the presence or absence of the Aβ binding polypeptide ABPP095. The results showed that the propensity of $A\beta_{40}$ to aggregate decreased in the presence of ABPP095. A diffusion time analysis, monitoring changes in the distribution of diffusion times, which reflects changes in aggregate size, is presented in FIG. 17. In the absence of ABPP095, a spread in diffusion times (TD) appeared after about 1 h, whereas in the presence of ABPP095 the diffusion times remained low.

Example 14

Intranasal Administration of Aβ Peptide Binding Polypeptides

Summary

Intranasal drug administration is an attractive route for delivery of compounds to the central nervous system (CNS). Efficacy of intranasally administered proteins has been demonstrated in a variety of rodent disease models (Thorne et al, (2004),Neuroscience, 127:481-496; De Rosa et al (2005), Proc. Natl. Acad. Sci. 102:3811-3816; Topkuru et al (2013), Stroke, 44:3189-3194; Lochhead et al, (2015), J Cereb. Blood Flow Met. 35:371-381) as well as in humans (reviewed in Lochhead and Thorne (2012), Adv. Drug Deliv. Rev. 64:614-628). Intranasal administration is therefore evaluated for delivery of Aβ peptide binding polypeptides to the brain and cerebrospinal fluid (CSF). Furthermore, in contrast to systemic injection, intranasal administration also avoids high exposure in the blood circulation, thus lowering the probability of systemic side effects.

Materials and Methods

Prebleeds of all animals, such as Sprague Dawley rats (from an accredited vendor), are collected ten days before dosing. Intranasal administration is carried out under isoflurane anesthesia. The animals are placed in a supine position and a total of 60 μl (1000 μg) Aβ peptide binding polypeptide, alone or in fusion with the albumin binding domain PP013 (SEQ ID NO:107), is administered by pipette in 10 μl drops, treating each nare every 2.5 min over a total of 10 min. 3 mM Pz-peptide (4-phenylazobenzoxy-carbonyl-Pro-Leu-Gly-Pro-DArg; Bachem) may be included in the Aβ peptide binding polypeptide formulation as a penetration enhancer. Animals are anaesthetized and sacrificed at 0.5, 2, 6, and 24 h after the first intranasal instillation. Blood samples are collected and the rats are then anesthetized using ketamine+xylazine/medetomidine for collection of CSF. After euthanization the rats are perfused with ice cold PBS and the olfactory bulbs are carefully harvested. The tissues are weighed, frozen on dry ice and stored at −80° C. until analysis. Brain tissues are prepared by addition of a lysis buffer followed by sonication. Cell debris is removed by centrifugation and the supernatant and CSF are subjected to an ELISA based determination of Aβ peptide binding polypeptide concentrations, for example as described in Example 11. The same ELISA method is applied to analyze serum from collected blood samples to evaluate the systemic exposure.

Results

The results are expected to show significant concentrations of Aβ peptide binding polypeptide in the olfactory bulb. The concentration in CSF and blood are expected to be low in concordance with Furrer et al (2009, J Neuroimmunol 215:65-72) and Thorne et al (supra). The olfactory bulb is connected with the nasal cavity through the olfactory system, and the brainstem is connected with the nasal passages through the peripheral trigeminal system. The delivery of Aβ peptide binding polypeptide to the CNS is expected to be much more efficient following intranasal administration than following a dose adjusted (for instance adjusted to obtain the same systems exposure) intravenous injection where penetration across the blood brain barrier is necessary.

Example 15

Characterization of Aβ Peptide Binding Polypeptides with an Alternative Scaffold Summary This Example describes the adaptation of the binding parts of Aβ peptide binding polypeptide ABPP095 in alternative scaffold sequences, as well as the analysis of such alternative sequences by circular dichroism (CD) spectroscopy and surface plasmon resonance (SPR).

Materials and Methods

Cloning of Scaffold Mutated Variants of ABPP095:

ABPP095 with a C-terminal His$_6$ tag (as used in Example 5 and 6) was further modified at scaffold positions, symmetrically within both moieties. Introduced mutations are listed in Table 5. Synthetic genes were ordered from DNA2.0. From the delivered plasmids, the DNA sequences encoding the polypeptides were cleaved and subsequently ligated into the expression vector pET26b+(Novagen) using the NdeI and XhoI restriction sites. The generated constructs with a C-terminal His$_6$ tag were in the general format ABPP095#-LEHHHHHH.

TABLE 5

Scaffold mutations within ABPP095

| Designation | SEQ ID NO: | Mutations in moiety 1 | Mutations in moiety 2 |
|---|---|---|---|
| ABPP095a | 551 | N41S, D42E | N101S, D102E |
| ABPP095b | 552 | A31S, N32E, A35S, N41S, D42E, A43S | A91S, N92E, A95S, N101S, D102E, A103S |
| ABPP095c | 553 | N12T, S22K, A31S, N32E, A35S, N41S, D42E, A43S | N72T, S82K, A91S, N92E, A95S, N101S, D102E, A103S |

Production of Scaffold Mutated Variants of ABPP095:

E. coli T7E2 cells (GeneBridges) were transformed with plasmids containing the gene fragments of each respective ABPP095 variant and cultivated in a fermenter (GRETA4, Belach Bioteknik AB) at 37° C. in approximately 940 ml of TSB-YE medium supplemented with 50 μg/ml kanamycin. In order to induce protein expression, IPTG was added to a final concentration of 0.17 mM at OD$_{600}$=2 and the cultivation was incubated at 37° C. for another 5 h. The cells were harvested by centrifugation.

Approximately 4 g of each cell pellet was re-suspended in 13 ml [20 mM sodium phosphate, 0.5 M NaCl, 20 mM imidazole, pH 7.4] and Benzonase® (Merck, cat. no. 1.01654.0001) was added to a concentration of approximately 90 U/ml. The cell suspension was transferred to 10 g Lysing Matrix B (MP Biomedicals, cat. no. 116540429) and the cells were disrupted using a FastPrep®-24 Instrument (MP Biomedicals). Cell debris was removed by centrifugation and each supernatant was applied on a 1 ml His GraviTrap IMAC column (GE Healthcare, cat. no. 11-0033-99). Contaminants were removed by washing with wash buffer (20 mM sodium phosphate, 0.5 M NaCl, 60 mM imidazole, pH 7.4) and the ABPP095 variants were subsequently eluted with 3 ml elution buffer (20 mM sodium phosphate, 0.5 M NaCl, 500 mM imidazole, pH 7.4). For reduction of disulfides, dithiothreitol (DTT) was added to a final concentration of 20 mM followed by incubation at RT for 1 h. Buffer exchange to [20 mM Tris-HCl, 150 mM NaCl, pH 8.0] was carried out using PD-10 Desalting columns (GE Healthcare, cat. no. 17-0851-01) and the samples were diluted to 0.2 mg/ml in the same buffer. Reduced glutathione (GSH; Sigma, cat. no. G-4251) and oxidized glutathione (GSSG; Sigma, cat. no. G-4376) was added to a concentration of 2 mM and 0.4 mM, respectively, followed by overnight incubation in the dark at 4° C. Each sample was further purified by reverse phase chromatography (RPC) using a 1 ml Resource RPC column (GE Healthcare, cat.no 17-1181-01) connected to an AKTAexplorer 10 system (GE Healthcare). Acetonitrile (ACN) was supplemented to a final concentration of 10% and the sample was loaded on the Resource RPC column equilibrated with Solvent A (10% ACN, 0.1% trifluoroacetic acid (TFA) in Milli-Q water). The column was washed with 5 CV of Solvent A prior to elution by a 0-60% linear gradient of Solvent B (80% ACN, 0.1% TFA in Milli-Q water) over 18 column volumes. Finally, buffer exchange to DPBS (Corning, cat. no. 21-031-CVR) was carried out using PD-10 Desalting columns.

For each protein, the concentration was determined by measuring the absorbance at 280 nm, using a NanoDrop® ND-1000 spectrophotometer and the extinction coefficient of the protein. The purity was analyzed by SDS-PAGE stained with Coomassie Blue and the identity of each purified ABPP095 variant was confirmed using HPLC-MS analysis (HPLC-MS 1100; Agilent Technologies).

Circular Dichroism Spectroscopy:

CD analysis was performed essentially as described in Example 6, but using a protein concentration of 0.5 mg/ml.

Biacore Kinetic Analysis:

Rough kinetic constants ($k_a$ and $k_d$) and affinities ($K_D$) for human Aβ$_{1-40}$, (hAβ$_{1-40}$), human Aβ$_{1-42}$ (hAβ$_{1-42}$) and mouse Aβ$_{1-40}$ (mAβ$_{1-40}$) were determined for ABPP095 (SEQ ID NO:95), its scaffold mutated derivatives ABPP095a (SEQ ID NO:551), ABPP095b (SEQ ID NO:552) and ABPP095c (SEQ ID NO:553) as well as for ABPP095-PP013 (SEQ ID NO:115) using a Biacore 2000 instrument (GE Healthcare). N-terminally biotinylated hAβ$_{1-40}$ (AnaSpec, cat. no. AS-24648), hAβ$_{1-42}$ (AnaSpec, cat. no. AS-24641-01) and mAβ$_{1-40}$ (AnaSpec, cat. no. AS-61717-01) were immobilized in separate flow cells on a streptavidin coated chip (Biacore Sensor Chip SA, cat. no. BR100032) and using HBS-EP as running buffer (0.01 M HEPES pH 7.4, 0.15 M NaCl, 3 mM EDTA, 0.005% v/v Surfactant P20, GE Healthcare, cat. no. BR100188). The ligand immobilization levels on the surfaces were 17 RU for hAβ$_{1-40}$, 16 RU for hAβ$_{1-42}$ and 22 RU for mAβ$_{1-40}$. One flow cell surface on the chip was used as blank during analyte injections. HBS-EP was used as running buffer and the flow rate was 30 µl/min. The analytes, i.e. Aβ peptide binding polypeptides, were each diluted in HBS-EP buffer to concentrations of 630, 210, 70, 23 and 8 nM and injected for 6 min, followed by dissociation in running buffer for 40 min. After dissociation, the surfaces were regenerated with 10 mM glycin pH 2.0. Kinetic constants were calculated from the sensorgrams using the Langmuir 1:1 model of BiaEvaluation software 4.1 (GE Healthcare).

Results

Production of Scaffold Mutated Variants of ABPP095:

All variants were expressed as soluble gene products in *E. coli*. SDS-PAGE analysis of each final protein preparation showed >98% purity. The correct oxidized monomer identity was confirmed by HPLC-MS analysis.

CD Analysis:

The melting temperatures (Tm) were determined using variable temperature measurements and showed that the Tm of the scaffold mutated variants were similar to the Tm of ABPP095 (Table 6). Reversible folding was observed for all mutated variants when overlaying spectra measured at 20° C. before and after heating to 90° C.

TABLE 6

Melting temperatures of scaffold mutated ABPP095 variants

| Designation | SEQ ID NO: | Tm (° C.) |
|---|---|---|
| ABPP095 | 95 | 43 |
| ABPP095a | 551 | 45 |
| ABPP095b | 552 | 45 |
| ABPP096c | 553 | 44 |

SPR Kinetic Analysis:

The interactions of ABPP095, its scaffold mutated derivatives ABPP095a, ABPP095b and ABPP095c as well as ABPP095-PP013, with hAβ$_{1-40}$, hAβ$_{1-42}$ and mAβ$_{1-40}$ were analyzed in a Biacore instrument by injecting various concentrations of the Aβ peptide binding polypeptides over a surface containing the respective Aβ peptide. All tested Aβ peptide binding polypeptides showed binding to the respective Aβ peptide variant. A summary of the kinetic parameters ($K_D$, $k_a$ and $k_d$) obtained using a 1:1 interaction model is given in Table 7.

TABLE 7

Kinetic data for binding to different Aβ peptides

| Designation | SEQ ID NO: | Target | $K_D$ (M) | $k_a$ (M$^{-1}$s$^{-1}$) | $k_d$ (s$^{-1}$) |
|---|---|---|---|---|---|
| ABPP095 | 95 | hAβ$_{1-40}$ | 5.0 × 10$^{-10}$ | 7.5 × 10$^4$ | 3.8 × 10$^{-5}$ |
| ABPP095a | 551 | hAβ$_{1-40}$ | 4.0 × 10$^{-9}$ | 7.4 × 10$^4$ | 3.0 × 10$^{-4}$ |
| ABPP095b | 552 | hAβ$_{1-40}$ | 1.3 × 10$^{-8}$ | 5.0 × 10$^4$ | 6.8 × 10$^{-4}$ |
| ABPP095c | 553 | hAβ$_{1-40}$ | 2.3 × 10$^{-9}$ | 8.1 × 10$^4$ | 1.9 × 10$^{-4}$ |
| ABPP095-PP013 | 115 | hAβ$_{1-40}$ | 2.7 × 10$^{-9}$ | 1.7 × 10$^4$ | 4.7 × 10$^{-5}$ |
| ABPP095 | 95 | hAβ$_{1-42}$ | 3.3 × 10$^{-10}$ | 1.2 × 10$^5$ | 4.1 × 10$^{-5}$ |
| ABPP095a | 551 | hAβ$_{1-42}$ | 5.0 × 10$^{-9}$ | 1.2 × 10$^5$ | 6.2 × 10$^{-4}$ |
| ABPP095b | 552 | hAβ$_{1-42}$ | 1.5 × 10$^{-8}$ | 1.0 × 10$^5$ | 1.5 × 10$^{-3}$ |
| ABPP095c | 553 | hAβ$_{1-42}$ | 2.6 × 10$^{-9}$ | 1.4 × 10$^5$ | 3.6 × 10$^{-4}$ |
| ABPP095-PP013 | 115 | hAβ$_{1-42}$ | 2.3 × 10$^{-9}$ | 2.2 × 10$^4$ | 4.9 × 10$^{-5}$ |
| ABPP095 | 95 | mAβ$_{1-40}$ | 1.8 × 10$^{-10}$ | 1.0 × 10$^5$ | 1.9 × 10$^{-5}$ |
| ABPP095a | 551 | mAβ$_{1-40}$ | 2.5 × 10$^{-9}$ | 1.0 × 10$^5$ | 2.6 × 10$^{-4}$ |
| ABPP095b | 552 | mAβ$_{1-40}$ | 8.7 × 10$^{-9}$ | 7.6 × 10$^4$ | 6.6 × 10$^{-4}$ |
| ABPP095c | 553 | mAβ$_{1-40}$ | 1.5 × 10$^{-9}$ | 1.0 × 10$^5$ | 1.5 × 10$^{-4}$ |
| ABPP095-PP013 | 115 | mAβ$_{1-40}$ | 1.3 × 10$^{-9}$ | 2.4 × 10$^4$ | 3.0 × 10$^{-5}$ |

Example 16

Analysis of Additional Aβ Peptide Binding Polypeptides

Materials and Methods

Subcloning of Aβ Peptide Binding Polypeptides for Screening:

Separate mixes of clones from each library (i.e the symmetric and the asymmetric library, respectively) obtained from the third rounds of cell sorting described in Example 2, were PCR amplified, restricted using endonucleases AccI and XhoI and ligated into the phagemid vector pAY02592 (essentially as described in Gronwall et al., supra) restricted using the same endonucleases. Transformations of the ligations were made into electrocompetent *E. coli* ER2738 (Lucigen).

Sequencing:

All individual clones were sequenced. PCR fragments were amplified from single colonies, sequenced and analyzed essentially as described in WO2009/077175.

Production of Aβ3 Peptide Binding Polypeptides for ELISA:

Sequenced Aβ peptide binding polypeptides were produced by inoculating single colonies from the bulk cloning in 1.2 ml TSB-YE medium supplemented with 100 µg/ml ampicillin and 0.1 mM IPTG in deep-well plates (Nunc, cat. no. 278752). The plates were incubated for 24 h at 37° C. Cells were pelleted by centrifugation, re-suspended in 150 µl PBST 0.05% (PBS supplemented with 0.05% Tween-20) and incubated at 82° C. in a water bath for 20 min. Cell suspensions were transferred to 96-well filtration plates (MerckMillipore, cat. no. MSNANLY50) and spun in a centrifuge at 1500×g for 4 min and the permeates were collected in new 96-well plates.

The supernatant of the periplasmic extract contained the Aβ peptide binding polypeptides as fusions to the albumin binding domain corresponding to GA3 of protein G from *Streptococcus* strain G148, here denoted ABD, expressed as AQH DEAL E-[AB PP ###]-VDYV-[AB D]-YVPG (Grönwall et al., supra). ABPP ### refers to individual, 107 amino acid residue Aβ peptide binding polypeptides.

ELISA Analysis of Aβ3 Peptide Binding Polypeptides:

The binding of Aβ peptide binding polypeptides to Aβ$_{1-40}$ was analyzed in a sandwich ELISA. Half-area 96-well ELISA plates (Costar, cat. no. 3690) were coated at 4° C. overnight with 2 µg/ml of an anti-ABD goat antibody (produced in-house) diluted in coating buffer (50 mM sodium carbonate, pH 9.6; Sigma, cat. no. C3041). The wells were blocked with 100 µl of PBSC (PBS supplemented with 0.5% casein; Sigma, cat. no. C8654) and 50 µl periplasmic solution was added to the wells and incubated for 30 min at RT. The wells were washed 4 times with PBST 0.05% whereafter 50 µl of N-terminally biotinylated hAβ$_{1-40}$ (AnaSpec, cat. no. AS-24648) at a concentration of 2 nM in PBSC was added to each well. The plates were incubated for 75 min at RT followed by 4 washes and addition of streptavidin conjugated HRP (Thermo Scientific, cat. no. N100) diluted 1:30 000 in PBSC. The plates were incubated for 30 min whereafter they were washed as described above. The plates were developed by addition of 50 µl 1-Step Ultra TMB (Thermo Scientific, cat. no. 34028) according to the manufacturer's recommendations.

The periplasmic fraction of the Aβ peptide binding polypeptide ABPP095 (SEQ ID NO:95) was used in duplicate as positive control on each ELISA plate. A negative control was created using ABD periplasm assayed against biotinylated hAβ$_{1-40}$. The absorbance at 450 nm was measured using a multi-well plate reader (EnSpire; Perkin Elmer).

ELISA EC50 Analysis of Aβ Peptide Binding Polypeptides:

A selection of Aβ peptide binding polypeptides was subjected to an analysis of the response against a dilution series of biotinylated hAβ$_{1-40}$ using ELISA essentially as described above. The assay was performed in 384-well high binding assay plates (Greiner, cat. no. 781061). Biotinylated protein was added at a concentration of 150 nM and diluted stepwise 1:5 down to 240 μM. All Aβ peptide binding polypeptides were also assayed without added target protein as a background control. Periplasm samples containing the Aβ peptide binding polypeptide ABPP095 were included and analyzed as a positive control. As a negative control, periplasm containing ABD only was assayed against the same target. Obtained values were analyzed using GraphPad Prism 5 and non-linear regression and EC50 values (the half maximal effective concentration) were calculated.

SPR Analysis of Periplasmic Samples:

A selection of Aβ peptide binding polypeptides was subjected to an analysis of the response against biotinylated hAβ$_{1-40}$ using a Biacore 2000 instrument (GE Healthcare). Biotinylated anti-ABD goat antibody (produced in-house) and N-terminally biotinylated hAβ$_{1-40}$ (AnaSpec cat. no. AS-24648) were immobilized in separate flow cells on a streptavidin coated chip (Biacore Sensor Chip SA, cat. no. BR100032) using HBS-EP as running buffer (0.01 M HEPES pH 7.4, 0.15 M NaCl, 3 mM EDTA, 0.005% v/v Surfactant P20, GE Healthcare, cat. no. BR100188). The ligand immobilization levels on the surfaces were approximately 2000 RU for the anti-ABD antibody and 225 RU for hAβ$_{1-40}$. One flow cell surface on the chip was used as blank during analyte injections. HBS-EP was used as running buffer and the flow rate was 25 μl/min. The analytes, i.e. periplasmic preparations of Aβ peptide binding polypeptides as described above, were each diluted 15× in HBS-EP buffer and injected for 10 min, followed by dissociation in running buffer for 5 min. After dissociation, the surfaces were regenerated with 2 pulses of 10 mM glycin pH 2.0. ABPP095 was included as first sample, in the middle and as last sample, as a reference in the analysis to ensure the stability of the surfaces and was in total run 6 times. Samples of ABD were included as blank control for the hAβ$_{1-40}$ surface.

Results

Subcloning of Aβ3 Peptide Binding Polypeptides for Screening:

From the third round of cell sorting described in Example 2, clones were subcloned in bulk to the vector pAY02592. The outcomes of the two different libraries were kept separate and clones were transformed to E. coli ER2738.

Sequencing:

Sequencing was performed after subcloning of individual colonies for identification. Out of a total of 1116 sequences (558 per library), 185 new unique polypeptide variants were identified in the output from the asymmetric library and 254 unique polypeptide variants were identified in the output from the symmetric library. Of these, 5 variants were identified in the output from both libraries. In addition, 51 polypeptide variants (21 from the asymmetric library and 30 from the symmetric library) already identified in the first screening described in Example 2 were picked up again.

ELISA Analysis of Aβ Peptide Binding Polypeptides:

The clones obtained after subcloning in bulk of the outcome after three rounds of cell sorting were produced in 96-well plates and screened for Aβ binding activity in ELISA. The average response of the negative controls was 0.063 AU. The majority of the Aβ peptide binding polypeptides were found to give a response of 0.2 AU or higher (corresponding to at least 3× the negative control) against hAβ$_{1-40}$ at a concentration of 2 nM. The amino acid sequences of those among these polypeptides which were newly identified (not included after the first screen of Example 2) are listed in FIG. 1A-1X as SEQ ID NO: 118-550. Polypeptide variants identified in the output from the asymmetric library are listed in FIG. 1A-X as SEQ ID NO:139-142, 155-159 and 376-550, and polypeptide variants identified in the output from the symmetric library are listed in FIG. 1A-X as SEQ ID NO:118-138, 143-154 and 160-374. The polypeptides with SEQ ID NO:229, 233, 248, 321 and 334 were identified in the output from both libraries.

ELISA EC50 Analysis of Aβ Peptide Binding Polypeptides:

A subset of Aβ peptide binding polypeptides was selected based on the result in the ELISA experiment described above and subjected to a target titration in ELISA format. Periplasm samples were incubated with a serial dilution of biotinylated hAβ$_{1-40}$. A periplasm sample with the Aβ peptide binding polypeptide ABPP095 (SEQ ID NO:95) was also assayed as a positive control. Obtained values were analyzed and their respective EC50 values were calculated (Table 8).

TABLE 8

EC50 values of polypeptides binding to hAβ$_{1-40}$

| Designation | SEQ ID NO: | EC50 (M) |
|---|---|---|
| ABPP107 | 118 | $4.8 \times 10^{-9}$ |
| ABPP108 | 119 | $5.8 \times 10^{-9}$ |
| ABPP109 | 120 | $5.0 \times 10^{-9}$ |
| ABPP111 | 122 | $1.4 \times 10^{-8}$ |
| ABPP112 | 123 | $4.6 \times 10^{-9}$ |
| ABPP113 | 124 | $3.8 \times 10^{-9}$ |
| ABPP115 | 126 | $3.9 \times 10^{-9}$ |
| ABPP116 | 127 | $3.7 \times 10^{-9}$ |
| ABPP117 | 128 | $6.4 \times 10^{-9}$ |
| ABPP118 | 129 | $5.2 \times 10^{-9}$ |
| ABPP119 | 130 | $3.9 \times 10^{-9}$ |
| ABPP120 | 131 | $3.5 \times 10^{-9}$ |
| ABPP121 | 132 | $5.9 \times 10^{-8}$ |
| ABPP122 | 133 | $5.2 \times 10^{-9}$ |
| ABPP123 | 134 | $5.4 \times 10^{-9}$ |
| ABPP124 | 135 | $1.3 \times 10^{-8}$ |
| ABPP125 | 136 | $4.3 \times 10^{-9}$ |
| ABPP126 | 137 | $5.9 \times 10^{-9}$ |
| ABPP127 | 138 | $5.7 \times 10^{-9}$ |
| ABPP128 | 139 | $5.2 \times 10^{-9}$ |
| ABPP129 | 140 | $9.0 \times 10^{-9}$ |
| ABPP130 | 141 | $6.0 \times 10^{-9}$ |
| ABPP131 | 142 | $6.8 \times 10^{-9}$ |
| ABPP132 | 143 | $8.1 \times 10^{-9}$ |
| ABPP133 | 144 | $4.2 \times 10^{-7}$ |
| ABPP134 | 145 | $2.7 \times 10^{-8}$ |
| ABPP135 | 146 | $6.3 \times 10^{-9}$ |
| ABPP136 | 147 | $7.9 \times 10^{-9}$ |
| ABPP137 | 148 | $8.4 \times 10^{-9}$ |
| ABPP139 | 150 | $8.4 \times 10^{-9}$ |
| ABPP140 | 151 | $4.1 \times 10^{-8}$ |
| ABPP143 | 154 | $9.3 \times 10^{-9}$ |
| ABPP144 | 155 | $1.6 \times 10^{-8}$ |
| ABPP145 | 156 | $9.4 \times 10^{-9}$ |
| ABPP146 | 157 | $8.6 \times 10^{-9}$ |
| ABPP147 | 158 | $7.9 \times 10^{-9}$ |
| ABPP148 | 159 | $6.0 \times 10^{-9}$ |
| ABPP049 | 49 | $7.1 \times 10^{-9}$ |
| ABPP051 | 51 | $4.6 \times 10^{-9}$ |
| ABPP055 | 55 | $2.8 \times 10^{-9}$ |
| ABPP059 | 59 | $1.3 \times 10^{-8}$ |

TABLE 8-continued

EC50 values of polypeptides binding to hAβ$_{1-40}$

| Designation | SEQ ID NO: | EC50 (M) |
|---|---|---|
| ABPP064 | 64 | 4.0 × 10$^{-9}$ |
| ABPP065 | 65 | 1.3 × 10$^{-8}$ |
| ABPP072 | 72 | 8.5 × 10$^{-9}$ |
| ABPP078 | 78 | 3.0 × 10$^{-8}$ |

[1] Analyzed in duplicate

SPR Analysis of Periplasmic Samples:

The interactions of a subset of Z variants with anti-ABD goat antibody and hAβ$_{1-40}$ were analyzed in a Biacore instrument by injecting dilutions of periplasmic samples. The responses against the two surfaces were monitored and are shown in Table 9. The response against the anti-ABD goat antibody shows the relative amount of Z variant in the periplasmic sample and the response against the hAβ$_{1-40}$ shows the binding capability of each variant in that relative dilution.

TABLE 9

Relative responses in SPR analysis

| Designation | SEQ ID NO: | Anti-ABD surface (Response RU) | hAβ$_{1-40}$ (Response RU) |
|---|---|---|---|
| ABPP107 | 118 | 42.2 | 15.6 |
| ABPP108 | 119 | 41.5 | 15.2 |
| ABPP109 | 120 | 42.0 | 20.2 |
| ABPP110 | 121 | 37.5 | 13.8 |
| ABPP111 | 122 | 35.6 | 14.2 |
| ABPP112 | 123 | 48.1 | 12.1 |
| ABPP113 | 124 | 42.0 | 20.2 |
| ABPP114 | 125 | 50.9 | 34.1 |
| ABPP115 | 126 | 39.7 | 13.3 |
| ABPP116 | 127 | 40.0 | 15.1 |
| ABPP117 | 128 | 31.6 | 9.7 |
| ABPP118 | 129 | 41.2 | 19.2 |
| ABPP119[1] | 130 | 31.8 ± 1.5 | 15.6 ± 1.5 |
| ABPP120 | 131 | 37.7 | 13.1 |
| ABPP121 | 132 | 47.4 | 47.5 |
| ABPP122 | 133 | 47.6 | 30.1 |
| ABPP123 | 134 | 38.8 | 15.5 |
| ABPP124 | 135 | 41.0 | 23.3 |
| ABPP125 | 136 | 38.6 | 18.4 |
| ABPP126 | 137 | 37.8 | 17.8 |
| ABPP127 | 138 | 31.9 | 9.1 |
| ABPP128 | 139 | 48.7 | 33.0 |
| ABPP129 | 140 | 43.6 | 35.8 |
| ABPP130 | 141 | 44.6 | 21.0 |
| ABPP131 | 142 | 34.7 | 18.9 |
| ABPP132 | 143 | 45.3 | 23.0 |
| ABPP133 | 144 | 38.9 | 14.5 |
| ABPP134 | 145 | 40.8 | 10.3 |
| ABPP135 | 146 | 35.0 | 14.9 |
| ABPP136 | 147 | 39.5 | 13.7 |
| ABPP137 | 148 | 35.2 | 15.3 |
| ABPP138 | 149 | 37.8 | 10.1 |
| ABPP139 | 150 | 32.7 | 10.4 |
| ABPP140 | 151 | 36.5 | 12.3 |
| ABPP141 | 152 | 31.5 | 10.5 |
| ABPP142 | 153 | 32.2 | 9.5 |
| ABPP143 | 154 | 31.7 | 15.8 |
| ABPP144 | 155 | 32.1 | 10.0 |
| ABPP145 | 156 | 34.3 | 15.2 |
| ABPP146 | 157 | 36.7 | 15.2 |
| ABPP147 | 158 | 39.2 | 17.0 |
| ABPP148 | 159 | 28.7 | 10.2 |
| ABPP035 | 35 | 31.8 | 8.6 |
| ABPP049 | 49 | 30.6 | 13.7 |
| ABPP051 | 51 | 51.5 | 21.4 |
| ABPP055[1] | 55 | 37.0 ± 1.1 | 18.2 ± 4.9 |
| ABPP059 | 59 | 39.5 | 15.4 |

TABLE 9-continued

Relative responses in SPR analysis

| Designation | SEQ ID NO: | Anti-ABD surface (Response RU) | hAβ$_{1-40}$ (Response RU) |
|---|---|---|---|
| ABPP064 | 64 | 38.8 | 12.0 |
| ABPP065 | 65 | 39.1 | 8.4 |
| ABPP070 | 70 | 40.7 | 16.6 |
| ABPP072 | 72 | 39.7 | 10.1 |
| ABPP078 | 78 | 38.6 | 12.5 |
| ABPP095[2] | 95 | 40.6 ± 2.2 | 24.6 ± 0.5 |
| ABD[1,3] | 117 | 19.8 ± 1.3 | 2.0 ± 0.3 |

[1] Analyzed 2 times, average presented
[2] Analyzed 6 times, average presented
[3] Lower molecular weight, hence lower RU expected Itemized List of Embodiments 1. Aβ peptide binding polypeptide, which comprises
   a first moiety comprising a first Aβ peptide binding motif BM1,
   a second moiety comprising a second Aβ peptide binding motif BM2, which motifs may be the same or different, and
   a linker,
   wherein each one of said binding motifs BM1 and BM2 consists of an amino acid sequence selected from (SEQ ID NO: 632)
i)  EX$_2$X$_3$YX$_5$X$_6$NLX$_9$A X$_{11}$QLCAX$_{16}$IX$_{18}$X$_{19}$X$_{20}$ ED wherein, independently from each other,
   X$_2$ is selected from I, M, Q, R, T and Y;
   X$_3$ is selected from H and V;
   X$_5$ is selected from F, I and L;
   X$_6$ is selected from P and T;
   X$_9$ is selected from N and T;
   X$_{11}$ is selected from D and H;
   X$_{16}$ is selected from F and I;
   X$_{18}$ is selected from N, Q and R;
   X$_{19}$ is selected from K and S; and
   X$_{20}$ is selected from F, I, L and R;
   and
ii) an amino acid sequence which has at least 95% identity to the sequence defined in i).

2. Aβ peptide binding polypeptide according to item 1, wherein sequence i) in BM1 consists of the amino acid sequence (SEQ ID NO: 558)
EX$_2$X$_3$YX$_5$X$_6$NLX$_9$A X$_{11}$QLCAFIX$_{18}$X$_{19}$L ED wherein, independently from each other,
   X$_2$ is selected from I, M, Q, R and Y;
   X$_3$ is selected from H and V;
   X$_5$ is selected from F, I and L;
   X$_6$ is selected from P and T;
   X$_9$ is selected from N and T;
   X$_{11}$ is selected from D and H;
   X$_{18}$ is selected from N, Q and R; and
   X$_{19}$ is selected from K and S.

3. Aβ peptide binding polypeptide according to item 2, wherein, independently from each other, X$_2$ is further selected from I, Q, R and Y; and X$_5$ is further selected from F and L.

4. Aβ peptide binding polypeptide according to item 2, wherein X$_2$ is further selected from I, M and R.

5. Aβ peptide binding polypeptide according to any preceding item, wherein sequence i) in BM2 consists of the amino acid sequence (SEQ ID NO: 560)
EX$_2$VYX$_5$PNLX$_9$A X$_{11}$QLCAX$_{16}$IX$_{18}$X$_{19}$X$_{20}$ ED wherein, independently from each other,
X$_2$ is selected from I, M, Q, R and T;
X$_5$ is selected from F and L;
X$_9$ is selected from N and T;
X$_{11}$ is selected from D and H;
X$_{16}$ is selected from F and I;
X$_{18}$ is selected from N, Q and R;
X$_{19}$ is selected from K and S; and
X$_{20}$ is selected from F, I, L and R.

6. Aβ peptide binding polypeptide according to item 5, wherein, independently from each other, X$_2$ is further selected from R and T; and X$_5$ is L.

7. Aβ peptide binding polypeptide according to item 5, wherein, independently from each other, X$_2$ is further selected from I, M, Q and R; X$_{16}$ is F; and X$_{20}$ is L.

8. Aβ peptide binding polypeptide according to any preceding item, wherein at least one of said first and second moieties comprises the amino acid sequence
X$_A$GX$_B$-[BM]
wherein BM is BM1 or BM2 as defined in any one of items 1-7, and, independently of each other,
X$_A$ is selected from A and S; and
X$_B$ is selected from G and R.

9. Aβ peptide binding polypeptide according to any one of items 1-7, wherein at least one of first and second moieties comprises a binding module amino acid sequence, Bmod, selected from (SEQ ID NO: 562)
iii) [BM]-DX$_a$SQX$_b$X$_c$X$_d$LLX$_e$ EAKKLX$_f$X$_g$X$_h$QA PX$_i$ wherein BM is BM1 or BM2 as defined in any one of items 1-7, and, independently of each other,
X$_a$ is selected from P, Q, R and S;
X$_b$ is selected from N, Q, R and S;
X$_c$ is selected from A and S;
X$_d$ is selected from K, N and E;
X$_e$ is selected from A, S and C;
X$_f$ is selected from E, N and S;
X$_g$ is selected from D, E and S;
X$_h$ is selected from A and S; and
X$_i$ is selected from no amino acid, A and K,
and
iv) an amino acid sequence which has at least 97% identity to a sequence defined in iii).

10. Aβ peptide binding polypeptide according to item 9, wherein sequence iii) consists of the amino acid sequence (SEQ ID NO: 563)
[BM]-DX$_a$SQX$_b$AX$_d$LLA EAKKLNDAQA PX$_i$ wherein BM is BM1 or BM2 as defined in any one of items 1-7, and, independently of each other,
X$_a$ is selected from P, Q, R and S;
X$_b$ is selected from N, Q, R and S;
X$_d$ is selected from K and N; and
X$_i$ is selected from no amino acid, A and K.

11. Aβ peptide binding polypeptide according to item 10, wherein sequence iii) consists of an amino acid sequence selected from (SEQ ID NO: 564)
[BM]-DPSQSANLLAEAKKLNDAQAP;

(SEQ ID NO: 565)
[BM]-DPSQQANLLAEAKKLNDAQAP;

(SEQ ID NO: 566)
[BM]-DSSQSANLLAEAKKLNDAQAP;

(SEQ ID NO: 567)
[BM]-DPSQQAKLLAEAKKLNDAQAP;

(SEQ ID NO: 568)
[BM]-DPSQNANLLAEAKKLNDAQAP;

(SEQ ID NO: 569)
[BM]-DRSQQANLLAEAKKLNDAQAP;

(SEQ ID NO: 570)
[BM]-DQSQRANLLAEAKKLNDAQAP;

(SEQ ID NO: 571)
[BM]-DQSQQANLLAEAKKLNDAQAP;

(SEQ ID NO: 572)
[BM]-DRSQSANLLAEAKKLNDAQAP;

(SEQ ID NO: 573)
[BM]-DRSQRANLLAEAKKLNDAQAP;
and (SEQ ID NO: 574)
[BM]-DRSQNANLLAEAKKLNDAQAP.

12. Aβ peptide binding polypeptide according to item 10, wherein said first moiety comprises a Bmod in which sequence iii) is an amino acid sequence selected from (SEQ ID NO: 575)
[BM1]-DPSQSANLLAEAKKLNDAQAPA;

(SEQ ID NO: 576)
[BM1]-DPSQQANLLAEAKKLNDAQAPA;

(SEQ ID NO: 577)
[BM1]-DSSQSANLLAEAKKLNDAQAPA;

(SEQ ID NO: 578)
[BM1]-DPSQRANLLAEAKKLNDAQAPA;

(SEQ ID NO: 579)
[BM1]-DPSQQAKLLAEAKKLNDAQAPA;

(SEQ ID NO: 580)
[BM1]-DPSQNANLLAEAKKLNDAQAPA;
and (SEQ ID NO: 581)
[BM1]-DRSQNANLLAEAKKLNDAQAPA.

13. Aβ peptide binding polypeptide according to item 10, wherein said second moiety comprises a Bmod in which sequence iii) is an amino acid sequence selected from (SEQ ID NO: 582)
[BM2]-DPSQQANLLAEAKKLNDAQAPK;

(SEQ ID NO: 583)
[BM2]-DPSQSANLLAEAKKLNDAQAPK;

(SEQ ID NO: 584)
[BM2]-DRSQQANLLAEAKKLNDAQAPK;

-continued

```
                                        (SEQ ID NO: 585)
[BM2]-DQSQRANLLAEAKKLNDAQAPK;

(SEQ ID NO: 586)
[BM2]-DQSQQANLLAEAKKLNDAQAPK;

(SEQ ID NO: 587)
[BM2]-DPSQRANLLAEAKKLNDAQAPK;

(SEQ ID NO: 588)
[BM2]-DRSQSANLLAEAKKLNDAQAPK;

(SEQ ID NO: 589)
[BM2]-DRSQRANLLAEAKKLNDAQAPK;

(SEQ ID NO: 590)
[BM2]-DSSQSANLLAEAKKLNDAQAPK;
and (SEQ ID NO: 591)
[BM2]-DPSQNANLLAEAKKLNDAQAPK.
```

14. Aβ peptide binding polypeptide according to any one of items 8-13, wherein at least one of first and second moieties comprises the amino acid sequence
$X_A G X_B$-[BMod]
wherein BMod is as defined in any one of items 9-13, and, independently of each other,
$X_A$ is selected from A and S; and
$X_B$ is selected from G and R.

15. Aβ peptide binding polypeptide according to item 14, wherein at least one of said first and second moieties comprises an amino acid sequence selected from

```
                                        (SEQ ID NO: 592)
AGG-[BM]-DPSQSANLLAEAKKLNDAQAP (SEQ ID NO: 593)
AGG-[BM]-DPSQQANLLAEAKKLNDAQAP (SEQ ID NO: 594)
AGG-[BM]-DSSQSANLLAEAKKLNDAQAP (SEQ ID NO: 595)
AGG-[BM]-DPSQRANLLAEAKKLNDAQAP (SEQ ID NO: 596)
AGR-[BM]-DPSQSANLLAEAKKLNDAQAP (SEQ ID NO: 597)
AGG-[BM]-DPSQQANLLAEAKKLNDAQAP (SEQ ID NO: 598)
AGG-[BM]-DPSQNANLLAEAKKLNDAQAP (SEQ ID NO: 599)
AGR-[BM]-DPSQQANLLAEAKKLNDAQAP (SEQ ID NO: 600)
AGR-[BM]-DRSQQANLLAEAKKLNDAQAP (SEQ ID NO: 601)
AGR-[BM]-DQSQRANLLAEAKKLNDAQAP (SEQ ID NO: 602)
AGR-[BM]-DQSQQANLLAEAKKLNDAQAP (SEQ ID NO: 603)
AGR-[BM]-DPSQRANLLAEAKKLNDAQAP (SEQ ID NO: 604)
AGR-[BM]-DRSQSANLLAEAKKLNDAQAP (SEQ ID NO: 605)
SGG-[BM]-DPSQSANLLAEAKKLNDAQAP (SEQ ID NO: 606)
AGR-[BM]-DRSQRANLLAEAKKLNDAQAP (SEQ ID NO: 607)
AGR-[BM]-DPSQNANLLAEAKKLNDAQAP (SEQ ID NO: 608)
AGR-[BM]-DSSQSANLLAEAKKLNDAQAP
and (SEQ ID NO: 609)
AGR-[BM]-DRSQNANLLAEAKKLNDAQAP.
```

16. Aβ peptide binding polypeptide according to item 14, wherein said first moiety comprises an amino acid sequence selected from

```
                                        (SEQ ID NO: 610)
AGG-[BM1]-DPSQSANLLAEAKKLNDAQAPA;

(SEQ ID NO: 611)
AGG-[BM1]-DPSQQANLLAEAKKLNDAQAPA;

(SEQ ID NO: 612)
AGG-[BM1]-DSSQSANLLAEAKKLNDAQAPA;

(SEQ ID NO: 613)
AGG-[BM1]-DPSQRANLLAEAKKLNDAQAPA;

(SEQ ID NO: 614)
AGR-[BM1]-DPSQSANLLAEAKKLNDAQAPA;

(SEQ ID NO: 615)
AGG-[BM1]-DPSQQAKLLAEAKKLNDAQAPA;
and (SEQ ID NO: 616)
AGG-[BM1]-DPSQNANLLAEAKKLNDAQAPA;

(SEQ ID NO: 617)
AGR-[BM1]-DPSQNANLLAEAKKLNDAQAP;

(SEQ ID NO: 618)
AGR-[BM1]-DSSQSANLLAEAKKLNDAQAP;
and (SEQ ID NO: 619)
AGR-[BM1]-DRSQNANLLAEAKKLNDAQAP.
```

17. Aβ peptide binding polypeptide according to item 14, wherein said second moiety comprises an amino acid sequence selected from

```
                                        (SEQ ID NO: 620)
AGR-[BM2]-DPSQQANLLAEAKKLNDAQAPK;

(SEQ ID NO: 621)
AGR-[BM2]-DPSQSANLLAEAKKLNDAQAPK;

(SEQ ID NO: 622)
AGR-[BM2]-DRSQQANLLAEAKKLNDAQAPK;

(SEQ ID NO: 623)
AGR-[BM2]-DQSQRANLLAEAKKLNDAQAPK;

(SEQ ID NO: 624)
AGR-[BM2]-DQSQQANLLAEAKKLNDAQAPK;

(SEQ ID NO: 625)
AGR-[BM2]-DPSQRANLLAEAKKLNDAQAPK;

(SEQ ID NO: 626)
AGR-[BM2]-DRSQSANLLAEAKKLNDAQAPK;

(SEQ ID NO: 627)
AGG-[BM2]-DPSQSANLLAEAKKLNDAQAPK;
```

```
                                                  (SEQ ID NO: 628)
SGG-[BM2]-DPSQSANLLAEAKKLNDAQAPK;

(SEQ ID NO: 629)
AGR-[BM2]-DRSQRANLLAEAKKLNDAQAPK;

(SEQ ID NO: 630)
AGG-[BM2]-DSSQSANLLAEAKKLNDAQAPK;
and (SEQ ID NO: 631)
AGG-[BM2]-DPSQNANLLAEAKKLNDAQAPK.
```

18. Aβ peptide binding polypeptide according to any one of items 1-17, wherein said linker is arranged between said first moiety and said second moiety.

19. Aβ peptide binding polypeptide according to item 18, wherein said linker is a flexible linker comprising at least one amino acid residue selected from the group consisting of glycine, serine and threonine.

20. Aβ peptide binding polypeptide according to item 19, wherein said linker has a general formula selected from $(G_nS_m)_p$ and $(S_nG_m)_p$,
wherein, independently,
n=1-7,
m=0-7,
n+m 8 and
p=1-10.

21. Aβ peptide binding polypeptide according to item 20, wherein n=1-5.

22. Aβ peptide binding polypeptide according to any one of items 20-21, wherein m=0-5.

23. Aβ peptide binding polypeptide according to any one of items 20-22, wherein p=1-5.

24. Aβ peptide binding polypeptide according to any one of items 20-23, wherein n=4, m=1 and p=2-3.

25. Aβ peptide binding polypeptide according to item 24, wherein said linker is selected from $(S_4G)_2$ (SEQ ID NO:633) and $(S_4G)_3$ (SEQ ID NO:634).

26. Aβ peptide binding polypeptide according to item 25, wherein said linker is $(S_4G)_2$ (SEQ ID NO:633).

27. Aβ peptide binding polypeptide according to item 25, wherein said linker is $(S_4G)_3$ (SEQ ID NO:634).

28. Aβ peptide binding polypeptide according to item 18, wherein said linker comprises an amino acid sequence selected from the group consisting of VEVDNKFNKEMAS (SEQ ID NO:635), VDNKFNKEMAS (SEQ ID NO:636), VEVDNKFNKE (SEQ ID NO:637), VDNKFNKE (SEQ ID NO:638), AEAKYAKE (SEQ ID NO:639), ADNNFNK (SEQ ID NO:640), ADNKFNK (SEQ ID NO:641), ADAQQNNFNK (SEQ ID NO:642), AQHDE (SEQ ID NO:643), VDNKFNK (SEQ ID NO:644), AEAKYAK (SEQ ID NO:645), VDAKYAK (SEQ ID NO:646), ADAKYAK (SEQ ID NO:647).

29. Aβ peptide binding polypeptide according to any one of items 20-28, wherein said linker further comprises 1-5 additional amino acid residues at the N- or C-terminal end of said linker, such as 1-4 additional amino acid residues, such as 1-3 additional amino acid residues, such as 3 additional amino acid residues.

30. Aβ peptide binding polypeptide according to item 29, wherein said additional amino acid residues are selected from the group consisting of AS, MAS and RAS.

31. Aβ peptide binding polypeptide according to any preceding item, comprising a first moiety as defined in item 12 and a second moiety as defined in item 13.

32. Aβ peptide binding polypeptide according any preceding item, comprising a first moiety as defined in item 16 and a second moiety as defined in item 17.

33. Aβ peptide binding polypeptide according to any preceding item, wherein
sequence i) of BM1 corresponds to amino acid residues 4-25 in any one of SEQ ID NO:1-106 and 118-553, and
sequence i) of BM2 corresponds to amino acid residues 64-85 in any one of SEQ ID NO:1-17, 19-106 and 118-553 or to amino acid residues 69-90 in SEQ ID NO:18.

34. Aβ peptide binding polypeptide according to item 33, wherein
sequence i) of BM1 corresponds to amino acid residues 4-25 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159, and
sequence i) of BM2 corresponds to amino acid residues 64-85 in any one of SEQ ID NO:1, 5, 9, 13, 14, 16, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 or to amino acid residues 69-90 in SEQ ID NO:18.

35. Aβ peptide binding polypeptide according to item 34, wherein
sequence i) of BM1 corresponds to amino acid residues 4-25 in any one of SEQ ID NO:18, 28, 35, 49, 50, 51, 55, 59, 64, 65, 70, 72, 78, 84, 95 and 118-159, and
sequence i) of BM2 corresponds to amino acid residues 64-85 in any one of SEQ ID NO:28, 35, 49, 50, 51, 55, 59, 64, 65, 70, 72, 78, 84, 95 and 118-159 or to amino acid residues 69-90 in SEQ ID NO:18.

36. Aβ peptide binding polypeptide according to item 35, wherein
sequence i) of BM1 corresponds to amino acid residues 4-25 in any one of SEQ ID NO:18, 70 and 95, and
sequence i) of BM2 corresponds to any one of amino acid residues 64-85 in SEQ ID NO:70 and 95 or to amino acid residues 69-90 in SEQ ID NO:18.

37. Aβ peptide binding polypeptide according to item 36, wherein
sequence i) of BM1 corresponds to amino acid residues 4-25 in SEQ ID NO:95 and
sequence i) of BM2 corresponds to amino acid residues 64-85 in SEQ ID NO:95.

38. Aβ peptide binding polypeptide according to any preceding item, wherein
the first moiety comprises amino acid residues 1-25 in any one of SEQ ID NO:1-106 and 118-553, and
the second moiety comprises amino acid residues 61-85 in any one of SEQ ID NO:1-17, 19-106 and 118-553 or amino acid residues 66-90 in SEQ ID NO:18.

39. Aβ peptide binding polypeptide according to item 38, wherein
the first moiety comprises amino acid residues 1-25 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159, and
the second moiety comprises amino acid residues 61-85 in any one of SEQ ID NO:1, 5, 9, 13, 14, 16, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 or amino acid residues 66-90 in SEQ ID NO:18.

40. Aβ peptide binding polypeptide according to item 39, wherein the first moiety comprises amino acid residues 1-25 in any one of SEQ ID NO: 18, 28, 35, 49, 50, 51, 55, 59, 64, 65, 70, 72, 78, 84, 95 and 118-159, and the second moiety comprises amino acid residues 61-85 in any one of SEQ ID NO:28, 35, 49, 50, 51, 55, 59, 64, 65, 70, 72, 78, 84, 95 and 118-159 or amino acid residues 66-90 in SEQ ID NO:18.

41. Aβ peptide binding polypeptide according to item 40, wherein the first moiety comprises amino acid residues 1-25 in any one of SEQ ID NO:18, 70 and 95, and the second moiety comprises amino acid residues 61-85 in any one of SEQ ID NO:70 and 95 or amino acid residues 66-90 in SEQ ID NO:18.

42. Aβ peptide binding polypeptide according to item 41, wherein the first moiety comprises amino acid residues 1-25 in SEQ ID NO:95, and the second moiety comprises amino acid residues 61-85 in SEQ ID NO:95.

43. Aβ peptide binding polypeptide according to any one of items 9-14, wherein sequence iii) in Bmod of the first moiety corresponds to amino acid residues 4-47 in any one of SEQ ID NO:1-106 and 118-553, and sequence iii) in Bmod of the second moiety corresponds to amino acid residues 64-107 in any one of SEQ ID NO:1-17, 19-106 and 118-553 or amino acid residues 69-112 in SEQ ID NO:18.

44. Aβ peptide binding polypeptide according to item 43, wherein sequence iii) in Bmod of the first moiety corresponds to amino acid residues 4-47 in any one of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159, and sequence iii) in Bmod of the second moiety corresponds to amino acid residues 64-107 in any one of SEQ ID NO:1, 5, 9, 13, 14, 16, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159 or amino acid residues 69-112 in SEQ ID NO:18.

45. Aβ peptide binding polypeptide according to item 44, wherein sequence iii) in Bmod of the first moiety corresponds to amino acid residues 4-47 in any one of SEQ ID NO:18, 28, 35, 49, 50, 51, 55, 59, 64, 65, 70, 72, 78, 84, 95 and 118-159, and sequence iii) in Bmod of the second moiety corresponds to amino acid residues 64-107 in any one of SEQ ID NO:28, 35, 49, 50, 51, 55, 59, 64, 65, 70, 72, 78, 84, 95 and 118-159 or amino acid residues 69-112 in SEQ ID NO:18.

46. Aβ peptide binding polypeptide according to item 45, wherein sequence iii) in Bmod of the first moiety corresponds to amino acid residues 4-47 in any one of SEQ ID NO:18, 70 and 95, and sequence iii) in Bmod of the second moiety corresponds to amino acid residues 64-107 in any one of SEQ ID NO:70 and 95 or amino acid residues 69-112 in SEQ ID NO:18.

47. Aβ peptide binding polypeptide according to item 46, wherein sequence iii) in Bmod of the first moiety corresponds to amino acid residues 4-47 in SEQ ID NO:95, and sequence iii) in Bmod of the second moiety corresponds to amino acid residues 64-107 in SEQ ID NO:95.

48. Aβ peptide binding polypeptide according to any one of items 33-47, wherein the first moiety comprises an amino acid sequence corresponding to amino acid residues 4-25, 1-25, 4-47 or 1-47 from any one of SEQ ID NO:1-106 and 118-553; and the second moiety comprises an amino acid sequence corresponding to amino acid residues 64-85, 61-85, 64-107 or 61-107 from any one of SEQ ID NO:1-17, 19-106 and 118-553 or to amino acid residues 69-90, 66-90, 69-112 or 66-112 from SEQ ID NO:18;

wherein both said amino acid sequences comprised in each of the first and second moieties are from the same SEQ ID NO.

49. Aβ peptide binding polypeptide comprising an amino acid sequence selected from the group consisting of SEQ ID NO:1-106 and 118-553; such as from the group consisting of SEQ ID NO:1, 5, 9, 13, 14, 16, 18, 20, 21, 25, 26, 28, 33, 35, 37, 40, 42, 48, 49, 50, 51, 53, 54, 55, 59, 60, 61, 62, 64, 65, 70, 72, 75, 78, 84, 89, 90, 95, 96, 97, 100, 104 and 118-159; such as from the group consisting of SEQ ID NO: 18, 28, 35, 49, 50, 51, 55, 59, 64, 65, 70, 72, 78, 84, 95 and 118-159, such as from the group consisting of SEQ ID NO 18, 70 and 95.

50. Aβ peptide binding polypeptide according to item 49, comprising the amino acid sequence SEQ ID NO:95.

51. Aβ peptide binding polypeptide according to any preceding item, which is capable of binding to Aβ peptide such that the $K_D$ value of the interaction is at most $1\times10^{-7}$ M, such as at most $1\times10^{-8}$ M, such as at most $1\times10^{-9}$ M, such as at most $1\times10^{-10}$ M.

52. Aβ peptide binding polypeptide, which constitutes a fragment of a polypeptide according to any preceding item, which fragment retains binding affinity for an Aβ peptide.

53. Aβ peptide binding polypeptide according to any preceding item, which comprises at least one additional amino acid residue at at least one of the N terminus and the C terminus.

54. Aβ peptide binding polypeptide according to item 53, which comprises additional amino acid residues at both the N terminus and the C terminus.

55. Aβ peptide binding polypeptide according any one of items 53-54, wherein said at least one additional amino acid residue improves or simplifies production, purification, stabilization in vivo or in vitro, coupling or detection of the polypeptide.

56. Fusion protein or conjugate, comprising a first part consisting of an Aβ peptide binding polypeptide according to any preceding item; and a second part consisting of a polypeptide having a desired biological activity.

57. Fusion protein or conjugate according to item 56, wherein said desired biological activity is a therapeutic activity.

58. Fusion protein or conjugate according to item 56 or 57, wherein said desired biological activity is a binding activity.

59. Fusion protein or conjugate according to item 58, wherein said binding activity of said second part is binding to Aβ peptide.

60. Fusion protein or conjugate according to item 58, wherein said binding activity is an albumin binding activity, which increases the in vivo half-life of the fusion protein or conjugate.

61. Fusion protein or conjugate according to item 60, wherein said second part comprises the albumin binding domain of streptococcal protein G or a derivative thereof, such as comprising the amino acid sequence SEQ ID NO:107, SEQ ID NO: 117 or a derivative thereof.

62. Fusion protein or conjugate according to item 58 or 59, wherein said binding activity acts to block a biological activity.

63. Fusion protein or conjugate according to item 58 or 59, wherein said binding activity acts to stimulate a biological activity.

64. Fusion protein or conjugate according to item 58, wherein said binding activity is binding to a target selected from the group consisting of Tau, apolipoprotein E (ApoE), beta-secretase 1 (BACE1), gamma-secretase, transferrin receptor (TfR), complement factor C1s, presenilin 1, presenilin 2, nicastrin, alpha-synuclein and Bri.

65. Fusion protein or conjugate according to item 56, wherein said desired biological activity is an enzymatic activity.

66. Fusion protein or conjugate according to item 57, wherein the second part is a therapeutically active polypeptide.

67. Fusion protein or conjugate according to any one of items 56-57 and 65-66, wherein the second part is selected from the group consisting of human endogenous enzymes, hormones, growth factors, chemokines, cytokines and lymphokines.

68. Fusion protein or conjugate according to any one of items 56-57 and 65-66, wherein the second part is selected from the group consisting of antibodies and antigen binding fragments thereof.

69. Fusion protein or conjugate according to item 68, wherein said antibody or antigen binding fragment thereof is selected from the group consisting of full-length antibodies, Fab fragments, Fab' fragments, F(ab')$_2$ fragments, Fc fragments, Fv fragments, single chain Fv fragments, (scFv)$_2$ and domain antibodies.

70. Fusion protein or conjugate according to item 68 or 69, wherein said antibody or antigen binding fragment thereof has an affinity for a target selected from the group consisting of Tau, apolipoprotein E (ApoE), beta-secretase 1 (BACE1), gamma-secretase, transferrin receptor (TfR), complement factor C1s, presenilin 1, presenilin 2, nicastrin, alpha-synuclein and Bri.

71. Fusion protein or conjugate according to any one of items 56-70, wherein the second part mediates transport of the fusion protein or conjugate to the cerebrospinal fluid or brain, for example being selected from the group consisting of transferrin, ghrelin, insulin and leptin.

72. Aβ peptide binding polypeptide, fusion protein or conjugate according to any preceding item, further comprising a label.

73. Aβ peptide binding polypeptide, fusion protein or conjugate according to item 72, wherein said label is selected from fluorescent dyes and metals, chromophoric dyes, chemiluminescent compounds and bioluminescent proteins, enzymes, radionuclides and radioactive particles.

74. Aβ peptide binding polypeptide, fusion protein or conjugate according to any preceding item, comprising a chelating environment provided by a polyaminopolycarboxylate chelator conjugated to the Aβ peptide binding polypeptide via a thiol group of a cysteine residue or an amine group of a lysine residue.

75. A polynucleotide encoding a polypeptide according to any one of items 1-71.

76. Expression vector comprising a polynucleotide according to item 75.

77. Host cell comprising an expression vector according to item 76.

78. Method of producing a polypeptide according to any one of items 1-71, comprising
    culturing a host cell according to item 77 under conditions permissive of expression of said polypeptide from said expression vector, and
    isolating said polypeptide.

79. Composition comprising an Aβ peptide binding polypeptide, fusion protein or conjugate according to any one of items 1-74 and at least one pharmaceutically acceptable excipient or carrier.

80. Composition according to item 79, further comprising at least one additional active agent.

81. Composition according to item 80, wherein said additional active agent is selected from the group consisting of inhibitors of neurotransmitter degradation, neurotransmitters, acetylcholinesterase inhibitors, NMDA receptor antagonists, TNF inhibitors, antihistamines, anti-viral agents, alpha-secretase activators, inhibitors of beta- or gamma-secretase, inhibitors of α-synuclein aggregation, inhibitors of tau aggregation, calcium channel blockers, compounds effective against oxidative stress, anti-apoptotic compounds, metal chelators, inhibitors of DNA repair such as pirenzepin and metabolites, attractants for Aβ clearing/depleting cellular components, inhibitors of N-terminal truncated Aβ including pyroglutamated Aβ$_{3-42}$, anti-inflammatory molecules, atypical antipsychotics such as clozapine, ziprasidone, risperidone, aripiprazole and olanzapine, cholinesterase inhibitors (ChEIs) such as tacrine, rivastigmine, donepezil and galantamine, M1 agonists and other drugs including any amyloid or tau modifying drug and nutritive supplements such as vitamin B12, cysteine, acetylcholine precursor, lecithin, choline, *Ginkgo biloba*, acetyl-L-carnitine, idebenone, propentofylline, and xanthine derivatives.

82. Composition according to item 81, wherein said additional active agent is selected from the group consisting of acetylcholinesterase inhibitors, NMDA receptor antagonists, TNF inhibitors, antihistamines and anti-viral agents.

83. Aβ peptide binding polypeptide, fusion protein or conjugate according to any one of items 1-74 or composition according to any one of items 80-82 for administration via a route selected from the group consisting of oral, intravenous, intraperitoneal, subcutaneous, intrathecal (e.g. via the Ommaya reservoir), pulmonary, transdermal, intramuscular, intranasal, buccal, sublingual or suppository administration, such as selected from the group consisting of oral, intrathecal, intravenous and intranasal administration.

84. Aβ peptide binding polypeptide, fusion protein or conjugate according to any one of items 1-74 or a composition according to any one of items 80-82 for use as a medicament, as a diagnostic agent or as a prognostic agent.

85. Aβ peptide binding polypeptide, fusion protein, conjugate or composition for use as a medicament according to item 84, whereby said polypeptide, fusion protein, conjugate or composition reduces the amount of Aβ peptide in blood.

86. Aβ peptide binding polypeptide, fusion protein, conjugate or composition for use as a medicament according to item 84, whereby said polypeptide, fusion protein, conjugate or composition slows down, stops or reverses an equilibrium between Aβ monomers and Aβ aggregates.

87. Aβ peptide binding polypeptide, fusion protein, conjugate or composition for use as a medicament according to item 84, whereby said polypeptide, fusion protein, conjugate or composition prevents or reverses Aβ aggregate formation.

88. Aβ peptide binding polypeptide, fusion protein, conjugate or composition for use according to any one of items 84-87 in the treatment, diagnosis or prognosis of an Aβ peptide associated condition, for example selected from the group consisting of amyloidosis, which refers to a group of diseases and disorders associated with amyloid plaque formation including secondary amyloidosis and age-related amyloidosis including, but not limited to, neurological disorders or conditions characterized by a loss of cognitive memory capacity such as, for example, Alzheimer's disease (AD), mild cognitive impairment (MCI), Lewybody dementia, Down's syndrome, hereditary cerebral hemorrhage with amyloidosis (Dutch type), the Guam Parkinson-dementia complex; as well as other diseases which are based on or associated with amyloid-like proteins such as cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, and senile cardiac amyloidosis; and various eye diseases including glaucoma, macular degeneration, drusen-related optic neuropathy, and cataract due to beta-amyloid deposition.

89. Aβ peptide binding polypeptide, fusion protein, conjugate or composition for use according to item 88, wherein the Aβ peptide associated condition is Alzheimer's disease.

90. Method for detecting an Aβ peptide in a sample, comprising
  providing a sample suspected to contain Aβ peptide,
  contacting said sample with an Aβ peptide binding polypeptide, fusion protein or conjugate according to any one of items 1-74 or a composition according to any one of items 80-82, and
  detecting binding of the Aβ peptide binding polypeptide, fusion protein, conjugate or composition,
  wherein detection of binding indicates the presence of Aβ peptide in the sample.

91. Method for determining the presence of Aβ peptide in a subject, the method comprising the steps:
  contacting the subject, or a sample isolated from the subject, with an Aβ peptide binding polypeptide, fusion protein or conjugate according to any one of items 1-74 or a composition according to any one of items 80-82, and
  obtaining a value corresponding to the amount of Aβ peptide binding polypeptide, fusion protein, conjugate or composition that has bound in said subject or to said sample.

92. Method according to item 91, further comprising a step of comparing said value to a reference.

93. Method according to item 91 or 92, wherein said subject is a mammalian subject, such as a human subject.

94. Method according to any one of items 91-93, wherein the sample is a biological fluid sample, such as a sample selected form the group consisting of a whole blood sample, a plasma sample and a serum sample.

95. Method according to any one of items 91-94, wherein the sample is a tissue sample.

96. Method according to any one of items 91-95, performed in vivo.

97. Method according to any one of items 91-95, performed in vitro.

98. Method of treatment of an Aβ peptide associated condition, comprising administering, to a subject in need thereof, an effective amount of an Aβ peptide binding polypeptide, fusion protein or conjugate according to any one of items 1-74 or a composition according to any one of items 80-82.

99. Method according to item 98, wherein said Aβ peptide associated condition is selected from the group consisting of amyloidosis, which refers to a group of diseases and disorders associated with amyloid plaque formation including secondary amyloidosis and age-related amyloidosis including, but not limited to, neurological disorders or conditions characterized by a loss of cognitive memory capacity such as, for example, Alzheimer's disease (AD), mild cognitive impairment (MCI), Lewybody dementia, Down's syndrome, hereditary cerebral hemorrhage with amyloidosis (Dutch type), the Guam Parkinson-dementia complex; as well as other diseases which are based on or associated with amyloid-like proteins such as cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, and senile cardiac amyloidosis; and various eye diseases including glaucoma, macular degeneration, drusen-related optic neuropathy, and cataract due to beta-amyloid deposition.

100. Method according to item 99, wherein said Aβ peptide associated condition is Alzheimer's disease.

101. Affinity matrix comprising an Aβ peptide binding polypeptide, fusion protein or conjugate according to any one of items 1-74.

102. Method of separation of Aβ peptide present in a sample from other constituents in the sample, comprising a step of affinity separation, in which step an Aβ peptide binding polypeptide according to any one of items 1-74 is used.

103. Method according to item 102, comprising the steps:
  applying the sample to an affinity matrix according to item 101 under conditions permissive for binding of Aβ peptide to the affinity matrix;
  washing the affinity matrix for removal of substances not bound thereto; and
  eluting the bound Aβ peptide from the affinity matrix, thus obtaining an Aβ peptide fraction with an enriched Aβ peptide content; and
  recovering said Aβ peptide fraction.

104. Method according to item 102, comprising the steps:
  applying the sample to an affinity matrix according to item 101 under conditions permissive for binding of Aβ peptide to the affinity matrix;
  washing the affinity matrix for recovery of substances not bound thereto, thus obtaining a depleted fraction with a substantially reduced Aβ peptide content; and
  recovering said depleted fraction.

105. Method for reducing the content of Aβ peptide in a portion of a body fluid of a human, comprising the steps:
  providing a portion of a body fluid from a human;
  applying the portion of a body fluid to an affinity matrix according to item 101 under conditions permissive for binding of Aβ peptide to the affinity matrix, thereby causing a reduction of the content of Aβ peptide in the portion of body fluid; and
  returning at least a part of said portion of body fluid to said human.

106. Method according to item 105, wherein said body fluid is whole blood.

107. Method according to item 105, wherein said body fluid is plasma.

108. Method according item 105, wherein said body fluid is serum.

109. Method according to any one of items 105-108, wherein said sample of a body fluid is obtained from a subject suffering from an Aβ peptide associated condition is selected from the group consisting of amyloidosis, which refers to a group of diseases and disorders associated with amyloid plaque formation including secondary amyloidosis and age-related amyloidosis including, but not limited to, neurological disorders or conditions characterized by a loss of cognitive memory capacity such as, for example, Alzheimer's disease (AD), mild cognitive impairment (MCI), Lewybody dementia, Down's syndrome, hereditary cerebral hemorrhage with amyloidosis (Dutch type), the Guam Parkinson-dementia complex; as well as other diseases which are based on or associated with amyloid-like proteins such as cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, and senile cardiac amyloidosis; and various eye diseases including glaucoma, macular degeneration, drusen-related optic neuropathy, and cataract due to beta-amyloid deposition.

SEQUENCE LISTING (651 sequences)

SEQ ID NO: 1 - protein, 107 aa, ARTIFICIAL SEQUENCE
  Engineered Abeta peptide binding dimer polypeptide
AGGEIVYFPNLNADQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 2 - protein, 107 aa, ARTIFICIAL SEQUENCE
  Engineered Abeta peptide binding dimer polypeptide
AGGEIVYFPNLNADQLCAFIQSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 3 - protein, 107 aa, ARTIFICIAL SEQUENCE
  Engineered Abeta peptide binding dimer polypeptide
AGGEIVYFPNLNAHQLCAFINSLEDDPSQQANLLAEAKKLNDAQAPASSSSGSSSSGRASAGRERVYLPNLNAHQLCAFIRSLEDDPSQSANLLAEAKKLNDAQAPK

SEQ ID NO: 4 - protein, 107 aa, ARTIFICIAL SEQUENCE
  Engineered Abeta peptide binding dimer polypeptide
AGGEIVYFPNLNAHQLCAFIRSLEDDPSQSANLLAEAKKLNDAQAPASSSSGSSSSGRASAGRERVYLPNLNAHQLCAFIQSLEDDPSQSANLLAEAKKLNDAQAPK

SEQ ID NO: 5 - protein, 107 aa, ARTIFICIAL SEQUENCE
  Engineered Abeta peptide binding dimer polypeptide
AGGERVYLPNLNADQLCAFIRSLEDDPSQSANLLAEAKKLNDAQAPASSSSGSSSSGRASAGRERVYLPNLNAHQLCAFINSIEDDPSQSANLLAEAKKLNDAQAPK

SEQ ID NO: 6 - protein, 107 aa, ARTIFICIAL SEQUENCE
  Engineered Abeta peptide binding dimer polypeptide
AGGEIVYLPNLNADQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 7 - protein, 107 aa, ARTIFICIAL SEQUENCE
  Engineered Abeta peptide binding dimer polypeptide
AGGEIVYFPNLNAHQLCAFIQSLEDDPSQSANLLAEAKKLNDAQAPASSSSGSSSSGRASAGRERVYLPNLNADQLCAFIRSREDDPSQQANLLAEAKKLNDAQAPK

SEQ ID NO: 8 - protein, 107 aa, ARTIFICIAL SEQUENCE
  Engineered Abeta peptide binding dimer polypeptide
AGGEIVYFPNLNADQLCAFINSLEDDPSQQANLLAEAKKLNDAQAPASSSSGSSSSGRASAGRERVYLPNLNAHQLCAFIRSLEDDRSQQANLLAEAKKLNDAQAPK

SEQ ID NO: 9 - protein, 107 aa, ARTIFICIAL SEQUENCE
  Engineered Abeta peptide binding dimer polypeptide
AGGERVYLPNLNADQLCAFIRSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 10 - protein, 107 aa, ARTIFICIAL SEQUENCE
  Engineered Abeta peptide binding dimer polypeptide
AGGEIVYFPNLNADQLCAFIQSLEDDPSQQANLLAEAKKLNDAQAPASSSSGSSSSGRASAGRERVYLPNLNADQLCAFIRSLEDDPSQSANLLAEAKKLNDAQAPK

SEQ ID NO: 11 - protein, 107 aa, ARTIFICIAL SEQUENCE
  Engineered Abeta peptide binding dimer polypeptide
AGGEIVYFPNLNAHQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 12 - protein, 107 aa, ARTIFICIAL SEQUENCE
  Engineered Abeta peptide binding dimer polypeptide
AGGEIVYFPNLNADQLCAFIRSLEDDPSQSANLLAEAKKLNDAQAPASSSSGSSSSGRASAGRERVYLPNLNAHQLCAFIQSLEDDPSQQANLLAEAKKLNDAQAPK

SEQ ID NO: 13 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAFIRSLEDDRSQQANLLAEAKKLNDAQAPK

SEQ ID NO: 14 - protein, 107 aa, ARTIFICIAL SEQUENCE
  Engineered Abeta peptide binding dimer polypeptide
AGGEIVYLPNLNAHQLCAFIQSLEDDPSQQANLLAEAKKLNDAQAPASSSSGSSSSGRASAGRERVYLPNLNADQLCAFINSLEDDPSQSANLLAEAKKLNDAQAPK

SEQ ID NO: 15 - protein, 107 aa, ARTIFICIAL SEQUENCE
  Engineered Abeta peptide binding dimer polypeptide
AGGEIVYFPNLNADQLCAFIQSLEDDPSQSANLLAEAKKLNDAQAPASSSSGSSSSGRASAGRERVYLPNLNAHQLCAIIRSLEDDPSQQANLLAEAKKLNDAQAPK

SEQ ID NO: 16 - protein, 107 aa, ARTIFICIAL SEQUENCE
  Engineered Abeta peptide binding dimer polypeptide
AGGEIHYFPNLNAHQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 17 - protein, 107 aa, ARTIFICIAL SEQUENCE
  Engineered Abeta peptide binding dimer polypeptide
AGGEIVYLPNLNAHQLCAFIQSLEDDPSQQANLLAEAKKLNDAQAPASSSSGSSSSGRASAGRERVYLPNLNAHQLCAFIRSLEDDPSQQANLLAEAKKLNDAQAPK

SEQ ID NO: 18 - protein, 112 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGSSSSGRASAGRERVYLPNLNADQLCAFIRSLEDDQSQRANLLAEAKKLNDAQAPK

SEQ ID NO: 19 - protein, 107 aa, ARTIFICIAL SEQUENCE
  Engineered Abeta peptide binding dimer polypeptide
AGGERVYLPNLNADQLCAFIRSLEDDPSQQANLLAEAKKLNDAQAPASSSSGSSSSGRASAGRERVYLPNLNADQLCAFIRSLEDDPSQSANLLAEAKKLNDAQAPK

SEQ ID NO: 20 - protein, 107 aa, ARTIFICIAL SEQUENCE
  Engineered Abeta peptide binding dimer polypeptide
AGGEIVYFPNLNAHQLCAFIRSLEDDPSQSANLLAEAKKLNDAQAPASSSSGSSSSGRASAGRERVYLPNLNAHQLCAFIQSIEDDPSQSANLLAEAKKLNDAQAPK

SEQ ID NO: 21 - protein, 107 aa, ARTIFICIAL SEQUENCE
  Engineered Abeta peptide binding dimer polypeptide
AGGEIVYFPNLNAHQLCAFIRSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 22 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAFIRSLEDDQSQQANLLAEAKKLNDAQAPK

SEQ ID NO: 23 - protein, 107 aa, ARTIFICIAL SEQUENCE
  Engineered Abeta peptide binding dimer polypeptide
AGGEIVYFPNLNADQLCAFIQSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 24 - protein, 107 aa, ARTIFICIAL SEQUENCE
  Engineered Abeta peptide binding dimer polypeptide
AGGEIVYLPNLNAHQLCAFINSLEDDPSQSANLLAEAKKLNDAQAPASSSSGSSSSGRASAGRERVYLPNLNAHQLCAFIQSLEDDPSQSANLLAEAKKLNDAQAPK

SEQ ID NO: 25 - protein, 107 aa, ARTIFICIAL SEQUENCE
  Engineered Abeta peptide binding dimer polypeptide
AGGERVYLPNLNAHQLCAFIRSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 26 - protein, 107 aa, ARTIFICIAL SEQUENCE
  Engineered Abeta peptide binding dimer polypeptide
AGGEIVYFPNLNAHQLCAFIRSLEDDPSQSANLLAEAKKLNDAQAPASSSSGSSSSGRASAGRERVYLPNLNADQLCAFINSLEDDPSQQANLLAEAKKLNDAQAPK

SEQ ID NO: 27 - protein, 107 aa, ARTIFICIAL SEQUENCE
  Engineered Abeta peptide binding dimer polypeptide
AGGEIVYFPNLNADQLCAFINSLEDDPSQSANLLAEAKKLNDAQAPASSSSGSSSSGRASAGRERVYLPNLNAHQLCAFIRSLEDDPSQRANLLAEAKKLNDAQAPK

SEQ ID NO: 28 - protein, 107 aa, ARTIFICIAL SEQUENCE
  Engineered Abeta peptide binding dimer polypeptide
AGGEIVYLPNLNAHQLCAFIQSLEDDPSQQANLLAEAKKLNDAQAPASSSSGSSSSGRASAGRERVYLPNLNAHQLCAFIQSLEDDPSQSANLLAEAKKLNDAQAPK

SEQ ID NO: 29 - protein, 107 aa, ARTIFICIAL SEQUENCE
  Engineered Abeta peptide binding dimer polypeptide
AGGEIVYFPNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 30 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNAHQLCAFIQSLEDDPSQSANLLAEAKKLNDAQAPK

SEQ ID NO: 31 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAIIRSLEDDPSQQANLLAEAKKLNDAQAPK

SEQ ID NO: 32 - protein, 107 aa, ARTIFICIAL SEQUENCE
  Engineered Abeta peptide binding dimer polypeptide
AGGEIVYFPNLNAHQLCAFIRSLEDDPSQSANLLAEAKKLNDAQAPASSSSGSSSSGRASAGRERVYLPNLNADQLCAFIQSLEDDQSQQANLLAEAKKLNDAQAPK

SEQ ID NO: 33 - protein, 107 aa, ARTIFICIAL SEQUENCE
  Engineered Abeta peptide binding dimer polypeptide
AGGEIVYFPNLNADQLCAFIQSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 34 - protein, 107 aa, ARTIFICIAL SEQUENCE
  Engineered Abeta peptide binding dimer polypeptide
AGGERVYLPNLNAHQLCAFIQSLEDDPSQSANLLAEAKKLNDAQAPASSSSGSSSSGRASAGRETVYLPNLNADQLCAFIRSLEDDPSQSANLLAEAKKLNDAQAPK

SEQ ID NO: 35 - protein, 107 aa, ARTIFICIAL SEQUENCE
  Engineered Abeta peptide binding dimer polypeptide
AGGEIVYFPNLNAHQLCAFIRSLEDDPSQQANLLAEAKKLNDAQAPASSSSGSSSSGRASAGRERVYLPNLNADQLCAFINSIEDDPSQSANLLAEAKKLNDAQAPK

SEQ ID NO: 36 - protein, 107 aa, ARTIFICIAL SEQUENCE
  Engineered Abeta peptide binding dimer polypeptide
AGGERVYLTNLNAHQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 37 - protein, 107 aa, ARTIFICIAL SEQUENCE
  Engineered Abeta peptide binding dimer polypeptide
AGGEIVYFPNLNADQLCAFIQSLEDDPSQQANLLAEAKKLNDAQAPASSSSGSSSSGRASAGRERVYLPNLNADQLCAFIRSLEDDRSQQANLLAEAKKLNDAQAPK

SEQ ID NO: 38 - protein, 107 aa, ARTIFICIAL SEQUENCE
  Engineered Abeta peptide binding dimer polypeptide
AGGEIVYLPNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 39 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNAHQLCAFIRSLEDDPSQQANLLAEAKKLNDAQAPK

SEQ ID NO: 40 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 41 - protein, 107 aa, ARTIFICIAL SEQUENCE
  Engineered Abeta peptide binding dimer polypeptide
AGGEIVYFPNLNAHQLCAFIQSLEDDSSQSANLLAEAKKLNDAQAPASSSSGSSSSGRASAGRERVYLPNLNADQLCAFIRSLEDDPSQQANLLAEAKKLNDAQAPK

SEQ ID NO: 42 - protein, 107 aa, ARTIFICIAL SEQUENCE
  Engineered Abeta peptide binding dimer polypeptide
AGGERVYLPNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 43 - protein, 107 aa, ARTIFICIAL SEQUENCE
  Engineered Abeta peptide binding dimer polypeptide
AGGEYVYLPNLNADQLCAFIQSLEDDPSQQANLLAEAKKLNDAQAPASSSSGSSSSGRASAGRERVYLPNLNAHQLCAFIRSFEDDPSQSANLLAEAKKLNDAQAPK

SEQ ID NO: 44 - protein, 107 aa, ARTIFICIAL SEQUENCE
  Engineered Abeta peptide binding dimer polypeptide
AGGEQVYFTNLNADQLCAFIQSLEDDPSQSANLLAEAKKLNDAQAPASSSSGSSSSGRASAGRERVYLPNLNAHQLCAFIRSIEDDRSQSANLLAEAKKLNDAQAPK

SEQ ID NO: 45 - protein, 107 aa, ARTIFICIAL SEQUENCE
  Engineered Abeta peptide binding dimer polypeptide
AGGEYVYFPNLNADQLCAFIQSLEDDPSQRANLLAEAKKLNDAQAPASSSSGSSSSGRASAGRERVYLPNLNAHQLCAFIRSLEDDPSQQANLLAEAKKLNDAQAPK

SEQ ID NO: 46 - protein, 107 aa, ARTIFICIAL SEQUENCE
  Engineered Abeta peptide binding dimer polypeptide
AGGEIVYFPNLNADQLCAFIRSLEDDPSQSANLLAEAKKLNDAQAPASSSSGSSSSGRASAGRERVYLPNLNADQLCAIIRSLEDDPSQQANLLAEAKKLNDAQAPK

SEQ ID NO: 47 - protein, 107 aa, ARTIFICIAL SEQUENCE
  Engineered Abeta peptide binding dimer polypeptide
AGGERVYLTNLNADQLCAFINSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 48 - protein, 107 aa, ARTIFICIAL SEQUENCE
  Engineered Abeta peptide binding dimer polypeptide
AGGEIVYFPNLNADQLCAFIQSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 49 - protein, 107 aa, ARTIFICIAL SEQUENCE
  Engineered Abeta peptide binding dimer polypeptide
AGGERVYFTNLNADQLCAFIQSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 50 - protein, 107 aa, ARTIFICIAL SEQUENCE
  Engineered Abeta peptide binding dimer polypeptide
AGGEIVYLPNLNADQLCAFIQSLEDDPSQSANLLAEAKKLNDAQAPASSSSGSSSSGRASAGRERVYLPNLNAHQLCAFIQSLEDDPSQQANLLAEAKKLNDAQAPK

SEQ ID NO: 51 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAFIRSIEDDRSQQANLLAEAKKLNDAQAPK

SEQ ID NO: 52 - protein, 107 aa, ARTIFICIAL SEQUENCE
  Engineered Abeta peptide binding dimer polypeptide
AGGEIVYLPNLNADQLCAFIRSLEDDPSQSANLLAEAKKLNDAQAPASSSSGSSSSGRASAGGERVYLPNLNAHQLCAFIQSLEDDPSQSANLLAEAKKLNDAQAPK

SEQ ID NO: 53 - protein, 107 aa, ARTIFICIAL SEQUENCE; identical to SEQ ID NO: 37
  Engineered Abeta peptide binding dimer polypeptide

SEQ ID NO: 54 - protein, 107 aa, ARTIFICIAL SEQUENCE; identical to SEQ ID NO: 39
  Engineered Abeta peptide binding dimer polypeptide

SEQ ID NO: 55 - protein, 107 aa, ARTIFICIAL SEQUENCE
  Engineered Abeta peptide binding dimer polypeptide
AGRERVYIPNLNADQLCAFIRSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 56 - protein, 107 aa, ARTIFICIAL SEQUENCE
  Engineered Abeta peptide binding dimer polypeptide
AGGERVYFTNLNADQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 57 - protein, 107 aa, ARTIFICIAL SEQUENCE
  Engineered Abeta peptide binding dimer polypeptide
AGRERVYFPNLNADQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 58 - protein, 107 aa, ARTIFICIAL SEQUENCE
  Engineered Abeta peptide binding dimer polypeptide
AGGERVYLPNLNADQLCAFIRSLEDDPSQSANLLAEAKKLNDAQAPASSSSGSSSSGRASAGGERVYFPNLNADQLCAFIQSLEDDPSQSANLLAEAKKLNDAQAPK

SEQ ID NO: 59 - protein, 107 aa, ARTIFICIAL SEQUENCE; identical to SEQ ID NO: 9
  Engineered Abeta peptide binding dimer polypeptide

SEQ ID NO: 60 - protein, 107 aa, ARTIFICIAL SEQUENCE
  Engineered Abeta peptide binding dimer polypeptide
AGGEIVYFPNLNADQLCAFIQSLEDDPSQQANLLAEAKKLNDAQAPASSSSGSSSSGRASAGRERVYLPNLNAHQLCAFIRSLEDDRSQQANLLAEAKKLNDAQAPK

SEQ ID NO: 61 - protein, 107 aa, ARTIFICIAL SEQUENCE
  Engineered Abeta peptide binding dimer polypeptide
AGGERVYLPNLNADQLCAFIRSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 62 - protein, 107 aa, ARTIFICIAL SEQUENCE
  Engineered Abeta peptide binding dimer polypeptide
AGGERVYLPNLNADQLCAFIQSLEDDPSQSANLLAEAKKLNDAQAPASSSSGSSSSGRASAGGEIVYFPNLNAHQLCAFINSLEDDPSQSANLLAEAKKLNDAQAPK

SEQ ID NO: 63 - protein, 107 aa, ARTIFICIAL SEQUENCE
  Engineered Abeta peptide binding dimer polypeptide
AGGERVYLPNLNAHQLCAFIQSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 64 - protein, 107 aa, ARTIFICIAL SEQUENCE
  Engineered Abeta peptide binding dimer polypeptide
AGGERVYLPNLNADQLCAFIQSLEDDPSQSANLLAEAKKLNDAQAPASSSSGSSSSGRASAGGERVYLPNLNAHQLCAFIQSLEDDPSQSANLLAEAKKLNDAQAPK

SEQ ID NO: 65 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 66 - protein, 107 aa, ARTIFICIAL SEQUENCE
  Engineered Abeta peptide binding dimer polypeptide
AGGEIVYFPNLNADQLCAFIQSLEDDPSQQANLLAEAKKLNDAQAPASSSSGSSSSGRASAGRERVYLPNLNAHQLCAFIRSLEDDPSQRANLLAEAKKLNDAQAPK

SEQ ID NO: 67 - protein, 107 aa, ARTIFICIAL SEQUENCE
  Engineered Abeta peptide binding dimer polypeptide
AGGEIVYFPNLNADQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 68 - protein, 107 aa, ARTIFICIAL SEQUENCE
  Engineered Abeta peptide binding dimer polypeptide
AGRERVYIPNLNAHQLCAFIRSLEDDPSQSANLLAEAKKLNDAQAPASSSSGSSSSGRASAGGEMVYFPNLNADQLCAFIRSLEDDPSQSANLLAEAKKLNDAQAPK

SEQ ID NO: 69 - protein, 107 aa, ARTIFICIAL SEQUENCE
  Engineered Abeta peptide binding dimer polypeptide
AGGEIVYFPNLNAHQLCAFINSLEDDPSQSANLLAEAKKLNDAQAPASSSSGSSSSGRASAGGERVYLPNLNAHQLCAFIRSLEDDPSQSANLLAEAKKLNDAQAPK

SEQ ID NO: 70 - protein, 107 aa, ARTIFICIAL SEQUENCE
  Engineered Abeta peptide binding dimer polypeptide
AGRERVYLPNLNADQLCAFIRSLEDDPSQSANLLAEAKKLNDAQAPASSSSGSSSSGRASAGGERVYLPNLNADQLCAFIQSLEDDPSQSANLLAEAKKLNDAQAPK

SEQ ID NO: 71 - protein, 107 aa, ARTIFICIAL SEQUENCE
  Engineered Abeta peptide binding dimer polypeptide
AGGEIVYLPNLNAHQLCAFIRSLEDDPSQSANLLAEAKKLNDAQAPASSSSGSSSSGRASAGRERVYLPNLNAHQLCAFIQSLEDDPSQSANLLAEAKKLNDAQAPK

SEQ ID NO: 72 - protein, 107 aa, ARTIFICIAL SEQUENCE
  Engineered Abeta peptide binding dimer polypeptide
AGRERVYLPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 73 - protein, 107 aa, ARTIFICIAL SEQUENCE
  Engineered Abeta peptide binding dimer polypeptide
AGGERVYLPNLNAHQLCAFIRSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 74 - protein, 107 aa, ARTIFICIAL SEQUENCE
  Engineered Abeta peptide binding dimer polypeptide
AGGERVYFPNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 75 - protein, 107 aa, ARTIFICIAL SEQUENCE
  Engineered Abeta peptide binding dimer polypeptide
AGGERVYLPNLNADQLCAFIQSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 76 - protein, 107 aa, ARTIFICIAL SEQUENCE
  Engineered Abeta peptide binding dimer polypeptide
AGGEIVYFPNLNADQLCAFIQSLEDDPSQQANLLAEAKKLNDAQAPASSSSGSSSSGRASAGRERVYLPNLNAHQLCAFIRSLEDDQSQQANLLAEAKKLNDAQAPK

SEQ ID NO: 77 - protein, 107 aa, ARTIFICIAL SEQUENCE; identical to SEQ ID NO: 48
  Engineered Abeta peptide binding dimer polypeptide

SEQ ID NO: 78 - protein, 107 aa, ARTIFICIAL SEQUENCE
  Engineered Abeta peptide binding dimer polypeptide
AGRERVYLPNLNAHQLCAFINSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 79 - protein, 107 aa, ARTIFICIAL SEQUENCE
  Engineered Abeta peptide binding dimer polypeptide
AGGEIVYLPNLNAHQLCAFIRSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 80 - protein, 107 aa, ARTIFICIAL SEQUENCE; identical to SEQ ID NO: 21
  Engineered Abeta peptide binding dimer polypeptide

SEQ ID NO: 81 - protein, 107 aa, ARTIFICIAL SEQUENCE
  Engineered Abeta peptide binding dimer polypeptide
AGGEIHYFPNLNADQLCAFIRSLEDDPSQSANLLAEAKKLNDAQAPASSSSGSSSSGRASAGRERVYLPNLNAHQLCAFIQSLEDDPSQQANLLAEAKKLNDAQAPK

SEQ ID NO: 82 - protein, 107 aa, ARTIFICIAL SEQUENCE
  Engineered Abeta peptide binding dimer polypeptide
AGGERVYLPNLNADQLCAFIRSLEDDSSQSANLLAEAKKLNDAQAPASSSSGSSSSGRASAGGEIVYFPNLNADQLCAFIRSLEDDPSQSANLLAEAKKLNDAQAPK

SEQ ID NO: 83 - protein, 107 aa, ARTIFICIAL SEQUENCE
  Engineered Abeta peptide binding dimer polypeptide
AGGERVYFPNLNADQLCAFIRSLEDDPSQSANLLAEAKKLNDAQAPASSSSGSSSSGRASSGGEIVYLPNLNAHQLCAFIQSLEDDPSQSANLLAEAKKLNDAQAPK

SEQ ID NO: 84 - protein, 107 aa, ARTIFICIAL SEQUENCE
  Engineered Abeta peptide binding dimer polypeptide
AGGERVYFTNLNADQLCAFIRSLEDDPSQQAKLLAEAKKLNDAQAPASSSSGSSSSGRASAGRERVYLPNLNADQLCAFIRSLEDDPSQSANLLAEAKKLNDAQAPK

SEQ ID NO: 85 - protein, 107 aa, ARTIFICIAL SEQUENCE
  Engineered Abeta peptide binding dimer polypeptide
AGGEIVYFPNLNADQLCAFIQSLEDDPSQNANLLAEAKKLNDAQAPASSSSGSSSSGRASAGGERVYLPNLNADQLCAFIRSLEDDPSQSANLLAEAKKLNDAQAPK

SEQ ID NO: 86 - protein, 107 aa, ARTIFICIAL SEQUENCE
  Engineered Abeta peptide binding dimer polypeptide
AGGEIVYFPNLNAHQLCAFIQSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 87 - protein, 107 aa, ARTIFICIAL SEQUENCE
  Engineered Abeta peptide binding dimer polypeptide
AGGEMVYLPNLNADQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 88 - protein, 107 aa, ARTIFICIAL SEQUENCE
  Engineered Abeta peptide binding dimer polypeptide
AGGEIVYFPNLNADQLCAFIRSLEDDPSQQANLLAEAKKLNDAQAPASSSSGSSSSGRASAGRERVYLPNLNADQLCAFIRSLEDDRSQRANLLAEAKKLNDAQAPK

SEQ ID NO: 89 - protein, 107 aa, ARTIFICIAL SEQUENCE
  Engineered Abeta peptide binding dimer polypeptide
AGGERVYLPNLNAHQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 90 - protein, 107 aa, ARTIFICIAL SEQUENCE
  Engineered Abeta peptide binding dimer polypeptide
AGGERVYLPNLNADQLCAFIQSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 91 - protein, 107 aa, ARTIFICIAL SEQUENCE
  Engineered Abeta peptide binding dimer polypeptide
AGGEIVYLPNLNADQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 92 - protein, 107 aa, ARTIFICIAL SEQUENCE
  Engineered Abeta peptide binding dimer polypeptide
AGGEIVYFPNLNADQLCAFIRSLEDDPSQNANLLAEAKKLNDAQAPASSSSGSSSSGRASAGREQVYLPNLNADQLCAFIRSLEDDPSQSANLLAEAKKLNDAQAPK

SEQ ID NO: 93 - protein, 107 aa, ARTIFICIAL SEQUENCE
  Engineered Abeta peptide binding dimer polypeptide
AGRERVYLPNLNAHQLCAFIRSLEDDPSQSANLLAEAKKLNDAQAPASSSSGSSSSGRASAGGEIVYFPNLNADQLCAFINSLEDDSSQSANLLAEAKKLNDAQAPK

SEQ ID NO: 94 - protein, 107 aa, ARTIFICIAL SEQUENCE
  Engineered Abeta peptide binding dimer polypeptide
AGGEIVYLPNLNADQLCAFIRSLEDDPSQSANLLAEAKKLNDAQAPASSSSGSSSSGRASAGGEQVYLPNLNADQLCAFIRSLEDDPSQSANLLAEAKKLNDAQAPK

SEQ ID NO: 95 - protein, 107 aa, ARTIFICIAL SEQUENCE
  Engineered Abeta peptide binding dimer polypeptide
AGGERVYLPNLNADQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 96 - protein, 107 aa, ARTIFICIAL SEQUENCE
  Engineered Abeta peptide binding dimer polypeptide
AGGERVYFPNLNAHQLCAFIRSLEDDPSQQANLLAEAKKLNDAQAPASSSSGSSSSGRASAGRERVYLPNLNADQLCAFIQSLEDDPSQRANLLAEAKKLNDAQAPK

SEQ ID NO: 97 - protein, 107 aa, ARTIFICIAL SEQUENCE
  Engineered Abeta peptide binding dimer polypeptide
AGGEIVYLPNLNADQLCAFIRSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 98 - protein, 107 aa, ARTIFICIAL SEQUENCE
  Engineered Abeta peptide binding dimer polypeptide
AGGEIVYLPNLNAHQLCAFIRSLEDDPSQQANLLAEAKKLNDAQAPASSSSGSSSSGRASAGRERVYLPNLNADQLCAFIQSLEDDPSQSANLLAEAKKLNDAQAPK

SEQ ID NO: 99 - protein, 107 aa, ARTIFICIAL SEQUENCE
  Engineered Abeta peptide binding dimer polypeptide
AGGEIVYFPNLNADQLCAFINSLEDDPSQSANLLAEAKKLNDAQAPASSSSGSSSSGRASAGGERVYLPNLNADQLCAFIQSLEDDPSQSANLLAEAKKLNDAQAPK

SEQ ID NO: 100 - protein, 107 aa, ARTIFICIAL SEQUENCE; identical to SEQ ID NO: 4
  Engineered Abeta peptide binding dimer polypeptide

SEQ ID NO: 101 - protein, 107 aa, ARTIFICIAL SEQUENCE
  Engineered Abeta peptide binding dimer polypeptide
AGRERVYFPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 102 - protein, 107 aa, ARTIFICIAL SEQUENCE
  Engineered Abeta peptide binding dimer polypeptide
AGGEIHYFPNLNADQLCAFIRSLEDDPSQSANLLAEAKKLNDAQAPASSSSGSSSSGRASAGRERVYLPNLNADQLCAFIRSLEDDQSQQANLLAEAKKLNDAQAPK

SEQ ID NO: 103 - protein, 107 aa, ARTIFICIAL SEQUENCE
  Engineered Abeta peptide binding dimer polypeptide
AGGEIVYFPNLNADQLCAFIRSLEDDPSQSANLLAEAKKLNDAQAPASSSSGSSSSGRASAGGEQVYLPNLNADQLCAFIRSLEDDPSQSANLLAEAKKLNDAQAPK

SEQ ID NO: 104 - protein, 107 aa, ARTIFICIAL SEQUENCE; identical to SEQ ID NO: 103
  Engineered Abeta peptide binding dimer polypeptide

SEQ ID NO: 105 - protein, 107 aa, ARTIFICIAL SEQUENCE
  Engineered Abeta peptide binding dimer polypeptide
AGRERVYLPNLNADQLCAFIRSLEDDPSQSANLLAEAKKLNDAQAPASSSSGSSSSGRASAGGEIVYFPNLNADQLCAFIRSLEDDPSQNANLLAEAKKLNDAQAPK

SEQ ID NO: 106 - protein, 107 aa, ARTIFICIAL SEQUENCE
  Engineered Abeta peptide binding dimer polypeptide
AGGEIVYLPNLNAHQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 107 - protein, 46 aa, ARTIFICIAL SEQUENCE
  Engineered albumin binding domain
LAEAKEAANAELDSYGVSDFYKRLIDKAKTVEGVEALKDAILAALP

SEQ ID NO: 108 - protein, 58 aa, ARTIFICIAL SEQUENCE
  Engineered Taq binding polypeptide
VDNKFNKELGWATWEIFNLPNLNGVQVKAFIDSLRDDPSQSANLLAEAKKLNDAQAPK

SEQ ID NO: 109 - protein, 42 aa, HOMO SAPIENS [sequence omitted]

SEQ ID NO: 110 - protein, 40 aa, HOMO SAPIENS
DAEFRHDSGYEVHHQKLVFFAEDVGSNKGAIIGLMVGGVV

SEQ ID NO: 111 - protein, 58 aa, ARTIFICIAL SEQUENCE
  Engineered Abeta binding polypeptide
VDNKFNKEMASAGGEIVYLPNLNPDQLCAFIHSLHDDPSQSANLLAEAKKLNDAQAPK

SEQ ID NO: 112 - protein, 118 aa, ARTIFICIAL SEQUENCE
  Engineered Abeta peptide binding dimer polypeptide
VDNKFNKEMASAGGEIVYLPNLNPDQLCAFIHSLHDDPSQSANLLAEAKKLNDAQAPKVEVDNKFNKEMASAGGEIVYLPNLNPDQLCAFIHSLHDDPSQSANLLAEAKKLNDAQAPK

SEQ ID NO: 113 - protein, 105 aa, ARTIFICIAL SEQUENCE
  Engineered Abeta peptide binding dimer polypeptide
AGGEIVYLPNLNPDQLCAFIHSLHDDPSQSANLLAEAKKLNDAQAPKSSSGSSSGRASAGGEIVYLPNLNPDQLCAFIHSLHDDPSQSANLLAEAKKLNDAQAPK

SEQ ID NO: 114 - protein, 201 aa, ARTIFICIAL SEQUENCE
  Engineered albumin binding protein
KLLDALAKAKADALKEFNKYGVSDYYKNLINNAKTVEGVKDLQAQVVESAKKARISEATDGLSDFLKSQTPAEDTVKSIELAEAKVLANRELDKYGVSDYHKNLINNAKTVEGVKDLQAQVVESAKKARISEATDGLSDFLKSQTPAEDTVKSIELAEAKVLANRELDKYGVSDYYKNLINNAKTVEGVKALIDEILAALP

SEQ ID NO: 115 - protein, 164 aa, ARTIFICIAL SEQUENCE
  Abeta binding dimer fused to albumin binding domain
MAGGERVYLPNLNADQLCAFIRSLEDDPSQSANLLAEAKKLNDAQAPASSSSGSSSSGRASAGGERVYLPNLNADQLCAFIRSLEDDPSQSANLLAEAKKLNDAQAPKGAPGGGGSTSLAEAKEAANAELDSYGVSDFYKRLIDKAKTVEGVEALKDAILAALP

SEQ ID NO: 116 - protein, 172 aa, ARTIFICIAL SEQUENCE
  Taq binding dimer fused to albumin binding domain
MGSSLQVDNKFNKELGWATWEIFNLPNLNGVQVKAFIDSLRDDPSQSANLLAEAKKLNDAQAPKVDNKFNKELGWATWEIFNLPNLNGVQVKAFIDSLRDDPSQSANLLAEAKKLNDAQAPKVDGSLAEAKEAANAELDSYGVSDFYKRLIDKAKTVEGVEALKDAILAALP

SEQ ID NO: 117 - protein, 46 aa, Streptococcus sp. G148
LAEAKVLANRELDKYGVSDYYKNLINNAKTVEGVKALIDEILAALP

SEQ ID NO: 118 - protein, 107 aa, ARTIFICIAL SEQUENCE
  Engineered Abeta peptide binding polypeptide
AGRERVYLPNLNADQLCAFIRSLEDDRSQNANLLAEAKKLNDAQAPASSSSGSSSSGRASAGGEIVYFPNLNADQLCAFIRSLEDDSSQSANLLAEAKKLNDAQAPK

SEQ ID NO: 119 - protein, 107 aa, ARTIFICIAL SEQUENCE
  Engineered Abeta peptide binding polypeptide
AGRERVYLRNLNADQLCAFIRSLEDDPSQNANLLAEAKKLNDAQAPASSSSGSSSSGRASAGGEIVYFPNLNAHQLCAFIQSLEDDPSQSANLLAEAKKLNDAQAPK

SEQ ID NO: 120 - protein, 107 aa, ARTIFICIAL SEQUENCE
  Engineered Abeta peptide binding polypeptide
AGGERVYLPNLNAHQLCAFIQSLEDDPSQSANLLAEAKKLNDAQAPASSSSGSSSSGRASAGGERVYLPNLNAHQLCAFIRSLEDDPSQSANLLAEAKKLNDAQAPK

SEQ ID NO: 121 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 122 - protein, 107 aa, ARTIFICIAL SEQUENCE
  Engineered Abeta peptide binding polypeptide
AGRERVYFPNLNADQLCAFIQSLEDDPSQNANLLAEAKKLNDAQAPASSSSGSSSSGRASAGGERVYFPNLNADQLCAFIRSLEDDSSQSANLLAEAKKLNDAQAPK

SEQ ID NO: 123 - protein, 107 aa, ARTIFICIAL SEQUENCE
  Engineered Abeta peptide binding polypeptide
AGGEMVYLPNLNAHQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 124 - protein, 107 aa, ARTIFICIAL SEQUENCE
  Engineered Abeta peptide binding polypeptide
AGRERVYIPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 125 - protein, 107 aa, ARTIFICIAL SEQUENCE
  Engineered Abeta peptide binding polypeptide
AGGERVYFPNLNADQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 126 - protein, 107 aa, ARTIFICIAL SEQUENCE
  Engineered Abeta peptide binding polypeptide
AGRERVYLPNLNADQLCAFIQSLEDDSSQSANLLAEAKKLNDAQAPASSSSGSSSSGRASAGGEIVYFPNLNAHQLCAFIRSLEDDPSQSANLLAEAKKLNDAQAPK

SEQ ID NO: 127 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGERVYLPNLNADQLCAFINSLEDDPSQSANLLAEAKKLNDAQAPK

SEQ ID NO: 128 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGGEIVYFPNLNADQLCAFIRSLEDDSSQSANLLAEAKKLNDAQAPK

SEQ ID NO: 129 - protein, 107 aa, ARTIFICIAL SEQUENCE
  Engineered Abeta peptide binding polypeptide
AGRERVYIPNLNADQLCAFIRSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 130 - protein, 107 aa, ARTIFICIAL SEQUENCE
  Engineered Abeta peptide binding polypeptide
AGRERVYLPNLNADQLCAFIQSLEDDSSQSANLLAEAKKLNDAQAPASSSSGSSSSGRASAGGERVYFRNLNAHQLCAFIRSLEDDPSQSANLLAEAKKLNDAQAPK

SEQ ID NO: 131 - protein, 107 aa, ARTIFICIAL SEQUENCE
  Engineered Abeta peptide binding polypeptide
AGGEIVYFPNLNAHQLCAFIQSLEDDPSQNANLLAEAKKLNDAQAPASSSSGSSSSGRASAGGERVYFPNLNADQLCAFIRSLEDDPSQSANLLAEAKKLNDAQAPK

SEQ ID NO: 132 - protein, 107 aa, ARTIFICIAL SEQUENCE
  Engineered Abeta peptide binding polypeptide
AGRERVYLYNLNADQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 133 - protein, 107 aa, ARTIFICIAL SEQUENCE
  Engineered Abeta peptide binding polypeptide
AGGERVYFPNLNAHQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 134 - protein, 107 aa, ARTIFICIAL SEQUENCE
  Engineered Abeta peptide binding polypeptide
AGRERVYIPNLNAHQLCAFIRSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 135 - protein, 107 aa, ARTIFICIAL SEQUENCE
  Engineered Abeta peptide binding polypeptide
AGGERVYLPNLNADQLCAFIRSLEDDPSQNANLLAEAKKLNDAQAPASSSSGSSSSGRASAGGERVYFPNLNADQLCAFIRSLEDDPSQSANLLAEAKKLNDAQAPK

SEQ ID NO: 136 - protein, 107 aa, ARTIFICIAL SEQUENCE
  Engineered Abeta peptide binding polypeptide
AGRERVYLPNLNADQLCAFIRSLEDDPSQNANLLAEAKKLNDAQAPASSSSGSSSSGRASAGGERVYFPNLNADQLCAFIRSLEDDPSQSANLLAEAKKLNDAQAPK

SEQ ID NO: 137 - protein, 107 aa, ARTIFICIAL SEQUENCE
  Engineered Abeta peptide binding polypeptide
AGRERVYLPNLNAHQLCAFIQSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 138 - protein, 107 aa, ARTIFICIAL SEQUENCE
  Engineered Abeta peptide binding polypeptide
AGRERVYLPNLNAHQLCAFIRSLEDDSSQSANLLAEAKKLNDAQAPASSSSGSSSSGRASAGGEIVYFPNLNADQLCAFINSLEDDPSQSANLLAEAKKLNDAQAPK

SEQ ID NO: 139 - protein, 107 aa, ARTIFICIAL SEQUENCE
  Engineered Abeta peptide binding polypeptide
AGGERVYLTNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 140 - protein, 107 aa, ARTIFICIAL SEQUENCE
  Engineered Abeta peptide binding polypeptide
AGGERVYLTNLNADQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 141 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFIRSIEDDQSQRANLLAEAKKLNDAQAPK

SEQ ID NO: 142 - protein, 107 aa, ARTIFICIAL SEQUENCE
  Engineered Abeta peptide binding polypeptide
AGGERVYLTNLNADQLCAFIRSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 143 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGERVYLPNLNADQLCAFIQSLEDDPSQSANLLAEAKKLNDAQAPK

SEQ ID NO: 144 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYITNLNADQLCAFIQSLEDDPSQSANLLAEAKKLNDAQAPK

SEQ ID NO: 145 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 146 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGGERVYLPNLNAHQLCAFIRSLEDDPSQSANLLAEAKKLNDAQAPK

SEQ ID NO: 147 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYFPNLNADQLCAFIQSLEDDRSQSANLLAEAKKLNDAQAPK

SEQ ID NO: 148 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 149 - protein, 107 aa, ARTIFICIAL SEQUENCE
  Engineered Abeta peptide binding polypeptide
AGGEMVYLPNLNADQLCAFINSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 150 - protein, 107 aa, ARTIFICIAL SEQUENCE
  Engineered Abeta peptide binding polypeptide
AGRERVYLPNLNADQLCAFINSLEDDPSQSANLLAEAKKLNDAQAPASSSSGSSSSGRASAGGEIVYFPNLNADQLCAFIQSLEDDRSQSANLLAEAKKLNDAQAPK

SEQ ID NO: 151 - protein, 107 aa, ARTIFICIAL SEQUENCE
  Engineered Abeta peptide binding polypeptide
AGGERVYLPNLNADQLCAFIRSLEDDRSQSANLLAEAKKLNDAQAPASSSSGSSSSGRASAGGEIVYFPNLNADQLCAFIRSLEDDSSQSANLLAEAKKLNDAQAPK

SEQ ID NO: 152 - protein, 107 aa, ARTIFICIAL SEQUENCE
  Engineered Abeta peptide binding polypeptide
AGGEIVYFPNLNAHQLCAFIQSLEDDPSQNANLLAEAKKLNDAQAPASSSSGSSSSGRASAGGERVYFPNLNADQLCAFIRSLEDDSSQSANLLAEAKKLNDAQAPK

SEQ ID NO: 153 - protein, 107 aa, ARTIFICIAL SEQUENCE
  Engineered Abeta peptide binding polypeptide
AGRERVYLPNLNAHQLCAFIQSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 154 - protein, 107 aa, ARTIFICIAL SEQUENCE
  Engineered Abeta peptide binding polypeptide
AGRERVYLRNLNAHQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 155 - protein, 107 aa, ARTIFICIAL SEQUENCE
  Engineered Abeta peptide binding polypeptide
AGGERVYLPNLNAHQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 156 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 157 - protein, 107 aa, ARTIFICIAL SEQUENCE
  Engineered Abeta peptide binding polypeptide
AGGERVYLPNLNAHQLCAFIQSLEDDPSQQANLLAEAKKLNDAQAPASSSSGSSSSGRASAGRERVYLPNLNADQLCAFIRSLEDDPSQSANLLAEAKKLNDAQAPK

SEQ ID NO: 158 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 159 - protein, 107 aa, ARTIFICIAL SEQUENCE
  Engineered Abeta peptide binding polypeptide
AGGERVYFTNLNADQLCAFIRSLEDDPSQQANLLAEAKKLNDAQAPASSSSGSSSSGRASAGGEIVYFPNLNAHQLCAFINSLEDDPSQSANLLAEAKKLNDAQAPK

SEQ ID NO: 160 - protein, 107 aa, ARTIFICIAL SEQUENCE
  Engineered Abeta peptide binding polypeptide
AGRERVYLPNLNADQLCAFIRSLEDDSSQSANLLAEAKKLNDAQAPASSSSGSSSSGRASAGGEIVYFPNLNAHQLCAFIQSLEDDESQNANLLAEAKKLNDAQAPK

SEQ ID NO: 161 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 162 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 163 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 164 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 165 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGGEIVYFPNLNADQLCAFIQSLEDDSSQNANLLAEAKKLNDAQAPK

SEQ ID NO: 166 - protein, 107 aa, ARTIFICIAL SEQUENCE
  Engineered Abeta peptide binding polypeptide
AGGEQVYLPNLNADQLCAFIRSLEDDSSQSANLLAEAKKLNDAQAPASSSSGSSSSGRASAGGERVYLPNLNAHQLCAFIRSLEDDPSQSANLLAEAKKLNDAQAPK

SEQ ID NO: 167 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 168 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEMVYLPNLNAHQLCAFIRSLEDDPSQSANLLAEAKKLNDAQAPK

SEQ ID NO: 169 - protein, 107 aa, ARTIFICIAL SEQUENCE
  Engineered Abeta peptide binding polypeptide
AGGEQVYLPNLNADQLCAFIQSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 170 - protein, 107 aa, ARTIFICIAL SEQUENCE
  Engineered Abeta peptide binding polypeptide
AGGEQVYLPNLNAHQLCAFIRSLEDDPSQSANLLAEAKKLNDAQAPASSSSGSSSSGRASAGGEMVYLPNLNADQLCAFINSLEDDPSQSANLLAEAKKLNDAQAPK

SEQ ID NO: 171 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGRERVYLPNLNADQLCAFIQSLEDDPSQRANLLAEAKKLNDAQAPK

SEQ ID NO: 172 - protein, 107 aa, ARTIFICIAL SEQUENCE
  Engineered Abeta peptide binding polypeptide
AGGEMVYLPNLNADQLCAFIQSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 173 - protein, 107 aa, ARTIFICIAL SEQUENCE
  Engineered Abeta peptide binding polypeptide
AGRERVYLPNLNADQLCAFIRSLEDDPSQNANLLAEAKKLNDAQAPASSSSGSSSSGRASAGRERVYLPNLNADQLCAFINSLEDDPSQSANLLAEAKKLNDAQAPK

SEQ ID NO: 174 - protein, 107 aa, ARTIFICIAL SEQUENCE
  Engineered Abeta peptide binding polypeptide
AGGEMVYFPNLNADQLCAFIQSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 175 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 176 - protein, 107 aa, ARTIFICIAL SEQUENCE
  Engineered Abeta peptide binding polypeptide
AGGERVYLRNLNAHQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 177 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGGEIVYLPNLNADQLCAFIRSLEDDSSQNANLLAEAKKLNDAQAPK

SEQ ID NO: 178 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYLPNLNAHQLCAFINSLEDDPSQSANLLAEAKKLNDAQAPK

SEQ ID NO: 179 - protein, 107 aa, ARTIFICIAL SEQUENCE
  Engineered Abeta peptide binding polypeptide
AGGEIVYLPNLNADQLCAFIRSLEDDRSQSANLLAEAKKLNDAQAPASSSSGSSSSGRASAGGEIVYLPNLNAHQLCAFIRSLEDDPSQSANLLAEAKKLNDAQAPK

SEQ ID NO: 180 - protein, 107 aa, ARTIFICIAL SEQUENCE
  Engineered Abeta peptide binding polypeptide
AGGEQVYLPNLNAHQLCAFIRSLEDDPSQSANLLAEAKKLNDAQAPASSSSGSSSSGRASAGGERVYLPNLNADQLCAFIQSLEDDPSQNANLLAEAKKLNDAQAPK

SEQ ID NO: 181 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 182 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 183 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 184 - protein, 107 aa, ARTIFICIAL SEQUENCE
  Engineered Abeta peptide binding polypeptide
AGGEMVYFPNLNADQLCAFIQSLEDDPSQSANLLAEAKKLNDAQAPASSSSGSSSSGRASAGGERVYLPNLNAHQLCAFIQSLEDDPSQSANLLAEAKKLNDAQAPK

SEQ ID NO: 185 - protein, 107 aa, ARTIFICIAL SEQUENCE
  Engineered Abeta peptide binding polypeptide
AGGERVYLPNLNAHQLCAFIQSLEDDPSQNANLLAEAKKLNDAQAPASSSSGSSSSGRASAGGEIVYFPNLNADQLCAFIQSLEDDPSQSANLLAEAKKLNDAQAPK

SEQ ID NO: 186 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 187 - protein, 107 aa, ARTIFICIAL SEQUENCE
  Engineered Abeta peptide binding polypeptide
AGGEIVYLPNLNAHQLCAFIRSLEDDPSQQANLLAEAKKLNDAQAPASSSSGSSSSGRASAGGERVYLPNLNADQLCAFIRSLEDDPSQSANLLAEAKKLNDAQAPK

SEQ ID NO: 188 - protein, 107 aa, ARTIFICIAL SEQUENCE
  Engineered Abeta peptide binding polypeptide
AGRERVYLPNLNADQLCAFIRSLEDDSSQSANLLAEAKKLNDAQAPASSSSGSSSSGRASAGGEMVYLPNLNADQLCAFIRSLEDDPSQSANLLAEAKKLNDAQAPK

SEQ ID NO: 189 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 190 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 191 - protein, 107 aa, ARTIFICIAL SEQUENCE
  Engineered Abeta peptide binding polypeptide
AGGEMVYLPNLNADQLCAFIQSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 192 - protein, 107 aa, ARTIFICIAL SEQUENCE
  Engineered Abeta peptide binding polypeptide
AGGEIVYLPNLNAHQLCAFIQSLEDDPSQSANLLAEAKKLNDAQAPASSSSGSSSSGRASAGRERVYLPNLNADQLCAFINSLEDDPSQSANLLAEAKKLNDAQAPK

SEQ ID NO: 193 - protein, 107 aa, ARTIFICIAL SEQUENCE
  Engineered Abeta peptide binding polypeptide
AGGEYVYLPNLNADQLCAFIRSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 194 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 195 - protein, 107 aa, ARTIFICIAL SEQUENCE
  Engineered Abeta peptide binding polypeptide
AGGEIVYLPNLNAHQLCAFIRSLEDDPSQNANLLAEAKKLNDAQAPASSSSGSSSSGRASAGGEIVYFPNLNADQLCAFIRSLEDDPSQSANLLAEAKKLNDAQAPK

SEQ ID NO: 196 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 197 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 198 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEQVYLPNLNADQLCAFIQSLEDDPSQSANLLAEAKKLNDAQAPK

SEQ ID NO: 199 - protein, 107 aa, ARTIFICIAL SEQUENCE
  Engineered Abeta peptide binding polypeptide
AGGEIVYLPNLNAHQLCAFIRSLEDDPSQNANLLAEAKKLNDAQAPASSSSGSSSSGRASAGGEMVYLPNLNADQLCAFIQSLEDDPSQSANLLAEAKKLNDAQAPK

SEQ ID NO: 200 - protein, 107 aa, ARTIFICIAL SEQUENCE
  Engineered Abeta peptide binding polypeptide
AGGERVYLRNLNAHQLCAFIRSLEDDPSQSANLLAEAKKLNDAQAPASSSSGSSSSGRASAGGEIVYLPNLNAHQLCAFIRSLEDDRSQSANLLAEAKKLNDAQAPK

SEQ ID NO: 201 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEIVYLPNLNADQLCAFIQSLEDDSSQNANLLAEAKKLNDAQAPK

SEQ ID NO: 202 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 203 - protein, 107 aa, ARTIFICIAL SEQUENCE
  Engineered Abeta peptide binding polypeptide
AGGEIVYLRNLNADQLCAFINSLEDDPSQNANLLAEAKKLNDAQAPASSSSGSSSSGRASAGGERVYLPNLNAHQLCAFIRSLEDDPSQSANLLAEAKKLNDAQAPK

SEQ ID NO: 204 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 205 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGGEIVYLPNLNAHQLCAFIRSLEDDRSQSANLLAEAKKLNDAQAPK

SEQ ID NO: 206 - protein, 107 aa, ARTIFICIAL SEQUENCE
  Engineered Abeta peptide binding polypeptide
AGGERVYLPNLNADQLCAFIRSLEDDRSQSANLLAEAKKLNDAQAPASSSSGSSSSGRASAGGEMVYLPNLNADQLCAFIRSLEDDPSQSANLLAEAKKLNDAQAPK

SEQ ID NO: 207 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 208 - protein, 107 aa, ARTIFICIAL SEQUENCE
  Engineered Abeta peptide binding polypeptide
AGREYVYLPNLNADQLCAFIRSLEDDPSQSANLLAEAKKLNDAQAPASSSSGSSSSGRASAGRERVYLPNLNADQLCAFIQSLEDDPSQNANLLAEAKKLNDAQAPK

SEQ ID NO: 209 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGERVYLPNLNAHQLCAFIQSLEDDPSQSANLLAEAKKLNDAQAPK

SEQ ID NO: 210 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 211 - protein, 107 aa, ARTIFICIAL SEQUENCE
  Engineered Abeta peptide binding polypeptide
AGGERVYLPNLNADQLCAFIRSLEDDSSQSANLLAEAKKLNDAQAPASSSSGSSSSGRASAGGEIVYFPNLNADQLCAFIRSLEDDSSQNANLLAEAKKLNDAQAPK

SEQ ID NO: 212 - protein, 107 aa, ARTIFICIAL SEQUENCE
  Engineered Abeta peptide binding polypeptide
AGRERVYLPNLNAHQLCAFINSLEDDPSQSANLLAEAKKLNDAQAPASSSSGSSSSGRASAGGEIVYFPNLNAHQLCAFIQSLEDDESQNANLLAEAKKLNDAQAPK

SEQ ID NO: 213 - protein, 107 aa, ARTIFICIAL SEQUENCE
  Engineered Abeta peptide binding polypeptide
AGGEMVYLPNLNADQLCAFIQSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 214 - protein, 107 aa, ARTIFICIAL SEQUENCE
  Engineered Abeta peptide binding polypeptide
AGGERVYLPNLNADQLCAFIRSLEDDRSQNANLLAEAKKLNDAQAPASSSSGSSSSGRASAGGEIVYFPNLNADQLCAFIRSLEDDSSQSANLLAEAKKLNDAQAPK

SEQ ID NO: 215 - protein, 107 aa, ARTIFICIAL SEQUENCE
  Engineered Abeta peptide binding polypeptide
AGGEIVYLPNLNADQLCAFIQSLEDDSSQSANLLAEAKKLNDAQAPASSSSGSSSSGRASAGGEQVYLPNLNADQLCAFIRSLEDDPSQSANLLAEAKKLNDAQAPK

SEQ ID NO: 216 - protein, 107 aa, ARTIFICIAL SEQUENCE
  Engineered Abeta peptide binding polypeptide
AGGEMVYLPNLNAHQLCAFIRSLEDDPSQSANLLAEAKKLNDAQAPASSSSGSSSSGRASAGGEIVYLPNLNADQLCAFINSLEDDPSQSANLLAEAKKLNDAQAPK

SEQ ID NO: 217 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEMVYFPNLNAHQLCAFIRSLEDDPSQSANLLAEAKKLNDAQAPK

SEQ ID NO: 218 - protein, 107 aa, ARTIFICIAL SEQUENCE
  Engineered Abeta peptide binding polypeptide
AGGERVYFPNLNADQLCAFIRSLEDDPSQSANLLAEAKKLNDAQAPASSSSGSSSSGRASAGGEIVYLPNLNADQLCAFIQSLEDDQSQNANLLAEAKKLNDAQAPK

SEQ ID NO: 219 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEIVYFPNLNAHQLCAFIQSLEDDPSQSANLLAEAKKLNDAQAPK

SEQ ID NO: 220 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYLPNLNADQLCAFIRSLEDDQSQNANLLAEAKKLNDAQAPK

SEQ ID NO: 221 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 222 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGREQVYLPNLNADQLCAFIQSLEDDPSQSANLLAEAKKLNDAQAPK

SEQ ID NO: 223 - protein, 107 aa, ARTIFICIAL SEQUENCE
  Engineered Abeta peptide binding polypeptide
AGGERVYFPNLNAHQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 224 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGGEIVYLPNLNADQLCAFIQSLEDDPSQSANLLAEAKKLNDAQAPK

SEQ ID NO: 225 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 226 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGGEIVYLPNLNAHQLCAFINSLEDDPSQSANLLAEAKKLNDAQAPK

SEQ ID NO: 227 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 228 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGREIVYFPNLNADQLCAFIQSLEDDPSQNANLLAEAKKLNDAQAPK

SEQ ID NO: 229 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 230 - protein, 107 aa, ARTIFICIAL SEQUENCE
  Engineered Abeta peptide binding polypeptide
AGGERVYLYNLNADQLCAFIRSLEDDESQSANLLAEAKKLNDAQAPASSSSGSSSSGRASAGGERVYLPNLNADQLCAFIRSLEDDPSQSANLLAEAKKLNDAQAPK

SEQ ID NO: 231 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 232 - protein, 107 aa, ARTIFICIAL SEQUENCE
  Engineered Abeta peptide binding polypeptide
AGGERVYLTNLNADQLCAFIQSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 233 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 234 - protein, 107 aa, ARTIFICIAL SEQUENCE
  Engineered Abeta peptide binding polypeptide
AGGEIVYLPNLNADQLCAFIRSLEDDSSQSANLLAEAKKLNDAQAPASSSSGSSSSGRASAGGEIVYLPNLNAHQLCAFIRSLEDDPSQSANLLAEAKKLNDAQAPK

SEQ ID NO: 235 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSLEDDRSQSANLLAEAKKLNDAQAPK

SEQ ID NO: 236 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 237 - protein, 107 aa, ARTIFICIAL SEQUENCE
  Engineered Abeta peptide binding polypeptide
AGRERVYLRNLNADQLCAFIRSLEDDPSQNANLLAEAKKLNDAQAPASSSSGSSSSGRASAGGERVYLPNLNADQLCAFIRSLEDDQSQSANLLAEAKKLNDAQAPK

SEQ ID NO: 238 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 239 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 240 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 241 - protein, 107 aa, ARTIFICIAL SEQUENCE
  Engineered Abeta peptide binding polypeptide
AGGERVYLTNLNAHQLCAFIRSLEDDPSQQANLLAEAKKLNDAQAPASSSSGSSSSGRASAGRERVYLPNLNADQLCAFIQSLEDDPSQRANLLAEAKKLNDAQAPK

SEQ ID NO: 242 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGGEIVYLPNLNAHQLCAFIRSLEDDPSQNANLLAEAKKLNDAQAPK

SEQ ID NO: 243 - protein, 107 aa, ARTIFICIAL SEQUENCE
  Engineered Abeta peptide binding polypeptide
AGGERVYLPNLNADQLCAFIRSLEDDQSQNANLLAEAKKLNDAQAPASSSSGSSSSGRASAGGEIVYFPNLNADQLCAFIRSLEDDPSQSANLLAEAKKLNDAQAPK

SEQ ID NO: 244 - protein, 107 aa, ARTIFICIAL SEQUENCE
  Engineered Abeta peptide binding polypeptide
AGGEIVYFPNLNADQLCAFIRSLEDDESQNANLLAEAKKLNDAQAPASSSSGSSSSGRASAGREQVYLPNLNADQLCAFIRSLEDDPSQSANLLAEAKKLNDAQAPK

SEQ ID NO: 245 - protein, 107 aa, ARTIFICIAL SEQUENCE
  Engineered Abeta peptide binding polypeptide
AGGEIVYLPNLNADQLCAFIRSLEDDRSQSANLLAEAKKLNDAQAPASSSSGSSSSGRASAGGEIVYLPNLNADQLCAFIRSLEDDPSQSANLLAEAKKLNDAQAPK

SEQ ID NO: 246 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGGEIVYLPNLNADQLCAFIQSLEDDPSQNANLLAEAKKLNDAQAPK

SEQ ID NO: 247 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 248 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 249 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 250 - protein, 107 aa, ARTIFICIAL SEQUENCE
  Engineered Abeta peptide binding polypeptide
AGGEMVYLPNLNADQLCAFIRSLEDDPSQSANLLAEAKKLNDAQAPASSSSGSSSSGRASAGGEIVYFPNLNAHQLCAFIQSLEDDPSQSANLLAEAKKLNDAQAPK

SEQ ID NO: 251 - protein, 107 aa, ARTIFICIAL SEQUENCE
  Engineered Abeta peptide binding polypeptide
AGRERVYLPNLNADQLCAFIQSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 252 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 253 - protein, 107 aa, ARTIFICIAL SEQUENCE
  Engineered Abeta peptide binding polypeptide
AGGEYVYLPNLNAHQLCAFIQSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 254 - protein, 107 aa, ARTIFICIAL SEQUENCE
  Engineered Abeta peptide binding polypeptide
AGGEQVYLPNLNADQLCAFIQSLEDDPSQQANLLAEAKKLNDAQAPASSSSGSSSSGRASAGRERVYLPNLNADQLCAFIRSLEDDPSQSANLLAEAKKLNDAQAPK

SEQ ID NO: 255 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGGERVYLPNLNADQLCAFIRSLEDDQSQSANLLAEAKKLNDAQAPK

SEQ ID NO: 256 - protein, 107 aa, ARTIFICIAL SEQUENCE
  Engineered Abeta peptide binding polypeptide
AGGEIVYLPNLNADQLCAFIRSLEDDPSQNANLLAEAKKLNDAQAPASSSSGSSSSGRASAGGEMVYFPNLNADQLCAFIRSLEDDPSQSANLLAEAKKLNDAQAPK

SEQ ID NO: 257 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYLPNLNADQLCAFIRSLEDDSSQNANLLAEAKKLNDAQAPK

SEQ ID NO: 258 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGGEIVYFPNLNADQLCAFIRSLEDDRSQSANLLAEAKKLNDAQAPK

SEQ ID NO: 259 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 260 - protein, 107 aa, ARTIFICIAL SEQUENCE
  Engineered Abeta peptide binding polypeptide
AGRERVYLRNLNAHQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 261 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYLPNLNADQLCAFINSLEDDPSQSANLLAEAKKLNDAQAPK

SEQ ID NO: 262 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGERVYLPNLNADQLCAFIQSLEDDPSQSANLLAEAKKLNDAQAPK

SEQ ID NO: 263 - protein, 107 aa, ARTIFICIAL SEQUENCE
  Engineered Abeta peptide binding polypeptide
AGGERVYLPNLNADQLCAFIRSLEDDSSQSANLLAEAKKLNDAQAPASSSSGSSSSGRASAGGEIVYLPNLNADQLCAFIRSLEDDPSQSANLLAEAKKLNDAQAPK

SEQ ID NO: 264 - protein, 107 aa, ARTIFICIAL SEQUENCE
  Engineered Abeta peptide binding polypeptide
AGRERVYLPNLNADQLCAFIQSLEDDPSQSANLLAEAKKLNDAQAPASSSSGSSSSGRASAGGEIVYFPNLNADQLCAFIQSLEDDPSQSANLLAEAKKLNDAQAPK

SEQ ID NO: 265 - protein, 107 aa, ARTIFICIAL SEQUENCE
  Engineered Abeta peptide binding polypeptide
AGGEIVYFPNLNAHQLCAFIQSLEDDPSQNANLLAEAKKLNDAQAPASSSSGSSSSGRASAGGEIVYFPNLNADQLCAFIRSLEDDPSQSANLLAEAKKLNDAQAPK

SEQ ID NO: 266 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 267 - protein, 107 aa, ARTIFICIAL SEQUENCE
  Engineered Abeta peptide binding polypeptide
AGGERVYLRNLNAHQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 268 - protein, 107 aa, ARTIFICIAL SEQUENCE
  Engineered Abeta peptide binding polypeptide
AGGEMVYLPNLNADQLCAFIRSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 269 - protein, 107 aa, ARTIFICIAL SEQUENCE
  Engineered Abeta peptide binding polypeptide
AGGERVYLPNLNAHQLCAFIQSLEDDPSQSANLLAEAKKLNDAQAPASSSSGSSSSGRASAGGEIVYLPNLNADQLCAFINSLEDDPSQSANLLAEAKKLNDAQAPK

SEQ ID NO: 270 - protein, 107 aa, ARTIFICIAL SEQUENCE
  Engineered Abeta peptide binding polypeptide
AGGERVYLPNLNADQLCAFINSLEDDPSQSANLLAEAKKLNDAQAPASSSSGSSSSGRASAGGEYVYLPNLNADQLCAFIRSLEDDPSQSANLLAEAKKLNDAQAPK

SEQ ID NO: 271 - protein, 107 aa, ARTIFICIAL SEQUENCE
  Engineered Abeta peptide binding polypeptide
AGGEYVYLPNLNADQLCAFIQSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 272 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 273 - protein, 107 aa, ARTIFICIAL SEQUENCE
  Engineered Abeta peptide binding polypeptide
AGGEIVYLPNLNAHQLCAFIQSLEDDPSQSANLLAEAKKLNDAQAPASSSSGSSSSGRASAGGEIVYLPNLNADQLCAFIRSLEDDRSQSANLLAEAKKLNDAQAPK

SEQ ID NO: 274 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGRERVYFPNLNADQLCAFIQSLEDDPSQSANLLAEAKKLNDAQAPK

SEQ ID NO: 275 - protein, 107 aa, ARTIFICIAL SEQUENCE
  Engineered Abeta peptide binding polypeptide
AGREQVYFPNLNADQLCAFIQSLEDDPSQSANLLAEAKKLNDAQAPASSSSGSSSSGRASAGGEIVYLPNLNAHQLCAFIRSLEDDRSQSANLLAEAKKLNDAQAPK

SEQ ID NO: 276 - protein, 107 aa, ARTIFICIAL SEQUENCE
  Engineered Abeta peptide binding polypeptide
AGREYVYLPNLNADQLCAFIRSLEDDPSQSANLLAEAKKLNDAQAPASSSSGSSSSGRASAGGERVYFPNLNAHQLCAFIQSLEDDPSQSANLLAEAKKLNDAQAPK

SEQ ID NO: 277 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 278 - protein, 107 aa, ARTIFICIAL SEQUENCE
  Engineered Abeta peptide binding polypeptide
AGRERVYIPNLNADQLCAFIRSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 279 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGGEMVYFPNLNADQLCAFINSLEDDPSQSANLLAEAKKLNDAQAPK

SEQ ID NO: 280 - protein, 107 aa, ARTIFICIAL SEQUENCE
  Engineered Abeta peptide binding polypeptide
AGGEIVYLPNLNAHQLCAFIQSLEDDPSQNANLLAEAKKLNDAQAPASSSSGSSSSGRASAGGEIVYFPNLNADQLCAFIQSLEDDPSQSANLLAEAKKLNDAQAPK

SEQ ID NO: 281 - protein, 107 aa, ARTIFICIAL SEQUENCE
  Engineered Abeta peptide binding polypeptide
AGGEIVYLPNLNAHQLCAFINSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 282 - protein, 107 aa, ARTIFICIAL SEQUENCE
  Engineered Abeta peptide binding polypeptide
AGGEIVYLPNLNAHQLCAFIRSLEDDPSQNANLLAEAKKLNDAQAPASSSSGSSSSGRASAGGEIVYLPNLNADQLCAFIQSLEDDPSQSANLLAEAKKLNDAQAPK

SEQ ID NO: 283 - protein, 107 aa, ARTIFICIAL SEQUENCE
  Engineered Abeta peptide binding polypeptide
AGGEIVYLPNLNADQLCAFINSLEDDRSQNANLLAEAKKLNDAQAPASSSSGSSSSGRASAGGEIVYLPNLNADQLCAFIRSLEDDRSQSANLLAEAKKLNDAQAPK

SEQ ID NO: 284 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 285 - protein, 107 aa, ARTIFICIAL SEQUENCE
  Engineered Abeta peptide binding polypeptide
AGGEMVYLPNLNADQLCAFIRSLEDDPSQSANLLAEAKKLNDAQAPASSSSGSSSSGRASAGGEMVYLPNLNADQLCAFIQSLEDDPSQSANLLAEAKKLNDAQAPK

SEQ ID NO: 286 - protein, 107 aa, ARTIFICIAL SEQUENCE
  Engineered Abeta peptide binding polypeptide
AGGEIVYLPNLNADQLCAFIQSLEDDSSQSANLLAEAKKLNDAQAPASSSSGSSSSGRASAGGEIVYLPNLNAHQLCAFIRSLEDDPSQSANLLAEAKKLNDAQAPK

SEQ ID NO: 287 - protein, 107 aa, ARTIFICIAL SEQUENCE
  Engineered Abeta peptide binding polypeptide
AGGEIVYLPNLNADQLCAFIRSLEDDPSQNANLLAEAKKLNDAQAPASSSSGSSSSGRASAGGEIVYFPNLNADQLCAFIRSLEDDPSQSANLLAEAKKLNDAQAPK

SEQ ID NO: 288 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYITNLNADQLCAFIQSLEDDPSQSANLLAEAKKLNDAQAPK

SEQ ID NO: 289 - protein, 107 aa, ARTIFICIAL SEQUENCE
  Engineered Abeta peptide binding polypeptide
AGGEIVYLPNLNADQLCAFINSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 290 - protein, 107 aa, ARTIFICIAL SEQUENCE
  Engineered Abeta peptide binding polypeptide
AGGEIVYLPNLNAHQLCAFIQSLEDDPSQSANLLAEAKKLNDAQAPASSSSGSSSSGRASAGGERVYLPNLNAHQLCAFIQSLEDDPSQSANLLAEAKKLNDAQAPK

SEQ ID NO: 291 - protein, 107 aa, ARTIFICIAL SEQUENCE
  Engineered Abeta peptide binding polypeptide
AGRERVYLYNLNADQLCAFIRSLEDDPSQSANLLAEAKKLNDAQAPASSSSGSSSSGRASAGGEIVYFPNLNADQLCAFINSLEDDPSQSANLLAEAKKLNDAQAPK

SEQ ID NO: 292 - protein, 107 aa, ARTIFICIAL SEQUENCE
  Engineered Abeta peptide binding polypeptide
AGGEQVYLPNLNAHQLCAFIQSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 293 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYFPNLNADQLCAFIRSLEDDSSQSANLLAEAKKLNDAQAPK

SEQ ID NO: 294 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 295 - protein, 107 aa, ARTIFICIAL SEQUENCE
  Engineered Abeta peptide binding polypeptide
AGRERVYLPNLNADQLCAFIRSLEDDSSQNANLLAEAKKLNDAQAPASSSSGSSSSGRASAGGEIVYFPNLNADQLCAFIRSLEDDPSQSANLLAEAKKLNDAQAPK

SEQ ID NO: 296 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGERVYLPNLNADQLCAFIQSLEDDQSQSANLLAEAKKLNDAQAPK

SEQ ID NO: 297 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEQVYLPNLNADQLCAFIRSLEDDPSQSANLLAEAKKLNDAQAPK

SEQ ID NO: 298 - protein, 107 aa, ARTIFICIAL SEQUENCE
  Engineered Abeta peptide binding polypeptide
AGGEMVYLPNLNADQLCAFIRSLEDDESQSANLLAEAKKLNDAQAPASSSSGSSSSGRASAGGEIVYFPNLNADQLCAFIQSLEDDPSQSANLLAEAKKLNDAQAPK

SEQ ID NO: 299 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGERVYLPNLNAHQLCAFIQSLEDDPSQSANLLAEAKKLNDAQAPK

SEQ ID NO: 300 - protein, 107 aa, ARTIFICIAL SEQUENCE
  Engineered Abeta peptide binding polypeptide
AGRERVYLPNLNADQLCAFIRSLEDDRSQSANLLAEAKKLNDAQAPASSSSGSSSSGRASAGRERVYLPNLNADQLCAFIRSLEDDPSQRANLLAEAKKLNDAQAPK

SEQ ID NO: 301 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 302 - protein, 107 aa, ARTIFICIAL SEQUENCE
  Engineered Abeta peptide binding polypeptide
AGGERVYLPNLNADQLCAFINSLEDDPSQSANLLAEAKKLNDAQAPASSSSGSSSSGRASAGGEIVYFPNLNAHQLCAFIQSLEDDPSQSANLLAEAKKLNDAQAPK

SEQ ID NO: 303 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEYVYLPNLNAHQLCAFIRSLEDDPSQSANLLAEAKKLNDAQAPK

SEQ ID NO: 304 - protein, 107 aa, ARTIFICIAL SEQUENCE
  Engineered Abeta peptide binding polypeptide
AGGEIVYLPNLNADQLCAFIRSLEDDPSQQANLLAEAKKLNDAQAPASSSSGSSSSGRASAGRERVYLPNLNADQLCAFIRSLEDDRSQRANLLAEAKKLNDAQAPK

SEQ ID NO: 305 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 306 - protein, 107 aa, ARTIFICIAL SEQUENCE
  Engineered Abeta peptide binding polypeptide
AGGERVYFPNLNADQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 307 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 308 - protein, 107 aa, ARTIFICIAL SEQUENCE
  Engineered Abeta peptide binding polypeptide
AGRERVYLYNLNADQLCAFIRSLEDDPSQNANLLAEAKKLNDAQAPASSSSGSSSSGRASAGGEIVYLPNLNADQLCAFIRSLEDDPSQSANLLAEAKKLNDAQAPK

SEQ ID NO: 309 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEMVYLPNLNADQLCAFIQSLEDDPSQSANLLAEAKKLNDAQAPK

SEQ ID NO: 310 - protein, 107 aa, ARTIFICIAL SEQUENCE
  Engineered Abeta peptide binding polypeptide
AGGEMVYLPNLNADQLCAFIRSLEDDPSQSANLLAEAKKLNDAQAPASSSSGSSSSGRASAGGEMVYLPNLNAHQLCAFIRSLEDDPSQSANLLAEAKKLNDAQAPK

SEQ ID NO: 311 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYLPNLNAHQLCAFIRSLEDDSSQSANLLAEAKKLNDAQAPK

SEQ ID NO: 312 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGGERVYLPNLNAHQLCAFIQSLEDDRSQSANLLAEAKKLNDAQAPK

SEQ ID NO: 313 - protein, 107 aa, ARTIFICIAL SEQUENCE
  Engineered Abeta peptide binding polypeptide
AGGERVYLPNLNADQLCAFIRSLEDDPSQNANLLAEAKKLNDAQAPASSSSGSSSSGRASAGRERVYLPNLNADQLCAFIQSLEDDPSQSANLLAEAKKLNDAQAPK

SEQ ID NO: 314 - protein, 107 aa, ARTIFICIAL SEQUENCE
  Engineered Abeta peptide binding polypeptide
AGGEIVYFPNLNAHQLCAFINSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 315 - protein, 107 aa, ARTIFICIAL SEQUENCE
  Engineered Abeta peptide binding polypeptide
AGGEQVYLPNLNADQLCAFIRSLEDDSSQSANLLAEAKKLNDAQAPASSSSGSSSSGRASAGRERVYLPNLNADQLCAFIRSLEDDPSQQANLLAEAKKLNDAQAPK

SEQ ID NO: 316 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGGEMVYLPNLNAHQLCAFINSLEDDPSQSANLLAEAKKLNDAQAPK

SEQ ID NO: 317 - protein, 107 aa, ARTIFICIAL SEQUENCE
  Engineered Abeta peptide binding polypeptide
AGGEIVYFTNLNADQLCAFIRSLEDDESQSANLLAEAKKLNDAQAPASSSSGSSSSGRASAGGEIVYLPNLNAHQLCAFIQSLEDDPSQSANLLAEAKKLNDAQAPK

SEQ ID NO: 318 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 319 - protein, 107 aa, ARTIFICIAL SEQUENCE
  Engineered Abeta peptide binding polypeptide
AGGEIVYFPNLNAHQLCAFIQSLEDDPSQNANLLAEAKKLNDAQAPASSSSGSSSSGRASAGGERVYLPNLNADQLCAFINSLEDDPSQSANLLAEAKKLNDAQAPK

SEQ ID NO: 320 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGGEMVYLPNLNADQLCAFIQSLEDDSSQNANLLAEAKKLNDAQAPK

SEQ ID NO: 321 - protein, 107 aa, ARTIFICIAL SEQUENCE
  Engineered Abeta peptide binding polypeptide
AGGERVYLTNLNADQLCAFIRSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 322 - protein, 107 aa, ARTIFICIAL SEQUENCE
  Engineered Abeta peptide binding polypeptide
AGGEIVYLPNLNADQLCAFIRSLEDDRSQSANLLAEAKKLNDAQAPASSSSGSSSSGRASAGGEIVYLPNLNAHQLCAFIQSLEDDPSQSANLLAEAKKLNDAQAPK

SEQ ID NO: 323 - protein, 107 aa, ARTIFICIAL SEQUENCE
  Engineered Abeta peptide binding polypeptide
AGGERVYLPNLNAHQLCAFIQSLEDDRSQSANLLAEAKKLNDAQAPASSSSGSSSSGRASAGGEIVYLPNLNAHQLCAFIRSLEDDRSQSANLLAEAKKLNDAQAPK

SEQ ID NO: 324 - protein, 107 aa, ARTIFICIAL SEQUENCE
  Engineered Abeta peptide binding polypeptide
AGGEIVYFPNLNAHQLCAFIRSLEDDRSQSANLLAEAKKLNDAQAPASSSSGSSSSGRASAGRERVYLPNLNADQLCAFIRSLEDDPSQSANLLAEAKKLNDAQAPK

SEQ ID NO: 325 - protein, 107 aa, ARTIFICIAL SEQUENCE
  Engineered Abeta peptide binding polypeptide
AGREQVYLPNLNAHQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 326 - protein, 107 aa, ARTIFICIAL SEQUENCE
  Engineered Abeta peptide binding polypeptide
AGGEIVYFPNLNADQLCAFINSLEDDPSQSANLLAEAKKLNDAQAPASSSSGSSSSGRASAGGEQVYLPNLNADQLCAFIRSLEDDPSQSANLLAEAKKLNDAQAPK

SEQ ID NO: 327 - protein, 107 aa, ARTIFICIAL SEQUENCE
  Engineered Abeta peptide binding polypeptide
AGRERVYLYNLNADQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 328 - protein, 107 aa, ARTIFICIAL SEQUENCE
  Engineered Abeta peptide binding polypeptide
AGGERVYFPNLNADQLCAFIRSLEDDQSQSANLLAEAKKLNDAQAPASSSSGSSSSGRASAGGEIVYLPNLNADQLCAFIRSLEDDPSQSANLLAEAKKLNDAQAPK

SEQ ID NO: 329 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 330 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 331 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 332 - protein, 107 aa, ARTIFICIAL SEQUENCE
  Engineered Abeta peptide binding polypeptide
AGGEIVYFPNLNADQLCAFIQSLEDDSSQNANLLAEAKKLNDAQAPASSSSGSSSSGRASAGGERVYFPNLNADQLCAFIRSLEDDPSQSANLLAEAKKLNDAQAPK

SEQ ID NO: 333 - protein, 107 aa, ARTIFICIAL SEQUENCE
  Engineered Abeta peptide binding polypeptide
AGRERVYLYNLNADQLCAFIRSLEDDPSQSANLLAEAKKLNDAQAPASSSSGSSSSGRASAGGERVYLPNLNADQLCAFIRSLEDDPSQNANLLAEAKKLNDAQAPK

SEQ ID NO: 334 - protein, 107 aa, ARTIFICIAL SEQUENCE
  Engineered Abeta peptide binding polypeptide
AGGEIVYLPNLNADQLCAFIRSLEDDPSQQANLLAEAKKLNDAQAPASSSSGSSSSGRASAGRERVYLPNLNADQLCAFIQSIEDDPSQQANLLAEAKKLNDAQAPK

SEQ ID NO: 335 - protein, 107 aa, ARTIFICIAL SEQUENCE
  Engineered Abeta peptide binding polypeptide
AGGERVYLYNLNADQLCAFINSLEDDPSQSANLLAEAKKLNDAQAPASSSSGSSSSGRASAGGEIVYLPNLNADQLCAFIQSLEDDQSQSANLLAEAKKLNDAQAPK

SEQ ID NO: 336 - protein, 107 aa, ARTIFICIAL SEQUENCE
  Engineered Abeta peptide binding polypeptide
AGRERVYLPNLNADQLCAFIQSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 337 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGGEIVYLPNLNADQLCAFINSLEDDPSQSANLLAEAKKLNDAQAPK

SEQ ID NO: 338 - protein, 107 aa, ARTIFICIAL SEQUENCE
  Engineered Abeta peptide binding polypeptide
AGREIVYIPNLNADQLCAFIRSLEDDPSQSANLLAEAKKLNDAQAPASSSSGSSSSGRASAGGERVYLPNLNADQLCAFIRSLEDDPSQSANLLAEAKKLNDAQAPK

SEQ ID NO: 339 - protein, 107 aa, ARTIFICIAL SEQUENCE
  Engineered Abeta peptide binding polypeptide
AGRERVYIPNLNAHQLCAFIRSLEDDPSQSANLLAEAKKLNDAQAPASSSSGSSSSGRASAGGEMVYLPNLNADQLCAFIRSLEDDPSQSANLLAEAKKLNDAQAPK

SEQ ID NO: 340 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGREIVYFPNLNADQLCAFIQSLEDDPSQNANLLAEAKKLNDAQAPK

SEQ ID NO: 341 - protein, 107 aa, ARTIFICIAL SEQUENCE
  Engineered Abeta peptide binding polypeptide
AGGERVYLPNLNAHQLCAFIQSLEDDRSQSANLLAEAKKLNDAQAPASSSSGSSSSGRASAGGEIVYFPNLNADQLCAFINSLEDDPSQSANLLAEAKKLNDAQAPK

SEQ ID NO: 342 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGGEIVYLPNLNAHQLCAFIQSLEDDPSQSANLLAEAKKLNDAQAPK

SEQ ID NO: 343 - protein, 107 aa, ARTIFICIAL SEQUENCE
  Engineered Abeta peptide binding polypeptide
AGGEIVYLPNLNADQLCAFINSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 344 - protein, 107 aa, ARTIFICIAL SEQUENCE
  Engineered Abeta peptide binding polypeptide
AGRERVYLRNLNADQLCAFIRSLEDDPSQSANLLAEAKKLNDAQAPASSSSGSSSSGRASAGGEIVYFPNLNADQLCAFIRSLEDDQSQSANLLAEAKKLNDAQAPK

SEQ ID NO: 345 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 346 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGEMVYFPNLNAHQLCAFIRSLEDDPSQSANLLAEAKKLNDAQAPK

SEQ ID NO: 347 - protein, 107 aa, ARTIFICIAL SEQUENCE
  Engineered Abeta peptide binding polypeptide
AGREQVYLPNLNADQLCAFIRSLEDDPSQSANLLAEAKKLNDAQAPASSSSGSSSSGRASAGGEIVYFPNLNADQLCAFIRSLEDDRSQSANLLAEAKKLNDAQAPK

SEQ ID NO: 348 - protein, 107 aa, ARTIFICIAL SEQUENCE
  Engineered Abeta peptide binding polypeptide
AGREIVYLPNLNADQLCAFIRSLEDDPSQSANLLAEAKKLNDAQAPASSSSGSSSSGRASAGGEMVYLPNLNADQLCAFIQSLEDDPSQSANLLAEAKKLNDAQAPK

SEQ ID NO: 349 - protein, 107 aa, ARTIFICIAL SEQUENCE
  Engineered Abeta peptide binding polypeptide
AGGERVYLYNLNADQLCAFIRSLEDDESQSANLLAEAKKLNDAQAPASSSSGSSSSGRASAGGEIVYLPNLNADQLCAFIRSLEDDPSQSANLLAEAKKLNDAQAPK

SEQ ID NO: 350 - protein, 107 aa, ARTIFICIAL SEQUENCE
  Engineered Abeta peptide binding polypeptide
AGGEMVYLPNLNADQLCAFIRSLEDDPSQSANLLAEAKKLNDAQAPASSSSGSSSSGRASAGGERVYLPNLNADQLCAFIRSLEDDQSQSANLLAEAKKLNDAQAPK

SEQ ID NO: 351 - protein, 107 aa, ARTIFICIAL SEQUENCE
  Engineered Abeta peptide binding polypeptide
AGGEIVYFPNLNADQLCAFIRSLEDDPSQNANLLAEAKKLNDAQAPASSSSGSSSSGRASAGGEIVYLPNLNAHQLCAFIRSLEDDPSQSANLLAEAKKLNDAQAPK

SEQ ID NO: 352 - protein, 107 aa, ARTIFICIAL SEQUENCE
  Engineered Abeta peptide binding polypeptide
AGGEIVYFPNLNADQLCAFIRSLEDDPSQNANLLAEAKKLNDAQAPASSSSGSSSSGRASAGRERVYLPNLNADQLCAFIRSLEDDSSQNANLLAEAKKLNDAQAPK

SEQ ID NO: 353 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEMVYLPNLNADQLCAFINSLEDDPSQSANLLAEAKKLNDAQAPK

SEQ ID NO: 354 - protein, 107 aa, ARTIFICIAL SEQUENCE
  Engineered Abeta peptide binding polypeptide
AGRERVYLPNLNADQLCAFIRSLEDDSSQNANLLAEAKKLNDAQAPASSSSGSSSSGRASAGGEIVYLPNLNAHQLCAFINSLEDDPSQSANLLAEAKKLNDAQAPK

SEQ ID NO: 355 - protein, 107 aa, ARTIFICIAL SEQUENCE
  Engineered Abeta peptide binding polypeptide
AGREYVYLPNLNAHQLCAFIRSLEDDPSQSANLLAEAKKLNDAQAPASSSSGSSSSGRASAGRERVYLPNLNAHQLCAFIRSLEDDPSQSANLLAEAKKLNDAQAPK

SEQ ID NO: 356 - protein, 107 aa, ARTIFICIAL SEQUENCE
  Engineered Abeta peptide binding polypeptide
AGGERVYLPNLNADQLCAFINSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 357 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGERVYLPNLNADQLCAFIRSLEDDQSQSANLLAEAKKLNDAQAPK

SEQ ID NO: 358 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGGEIVYLPNLNADQLCAFIQSLEDDPSQSANLLAEAKKLNDAQAPK

SEQ ID NO: 359 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGGERVYLPNLNADQLCAFIQSLEDDPSQSANLLAEAKKLNDAQAPK

SEQ ID NO: 360 - protein, 107 aa, ARTIFICIAL SEQUENCE
  Engineered Abeta peptide binding polypeptide
AGRERVYLPNLNADQLCAFIRSLEDDPSQSANLLAEAKKLNDAQAPASSSSGSSSSGRASAGGEIVYIPNLNADQLCAFIRSLEDDPSQSANLLAEAKKLNDAQAPK

SEQ ID NO: 361 - protein, 107 aa, ARTIFICIAL SEQUENCE
  Engineered Abeta peptide binding polypeptide
AGGEYVYLPNLNADQLCAFIRSLEDDPSQSANLLAEAKKLNDAQAPASSSSGSSSSGRASAGGERVYFPNLNAHQLCAFIRSLEDDPSQSANLLAEAKKLNDAQAPK

SEQ ID NO: 362 - protein, 107 aa, ARTIFICIAL SEQUENCE
  Engineered Abeta peptide binding polypeptide
AGGERVYLPNLNADQLCAFIRSLEDDSSQSANLLAEAKKLNDAQAPASSSSGSSSSGRASAGGEIVYFPNLNADQLCAFIQSLEDDRSQSANLLAEAKKLNDAQAPK

SEQ ID NO: 363 - protein, 107 aa, ARTIFICIAL SEQUENCE
  Engineered Abeta peptide binding polypeptide
AGGEIVYLPNLNADQLCAFIQSLEDDQSQSANLLAEAKKLNDAQAPASSSSGSSSSGRASAGGEIVYLPNLNADQLCAFIQSLEDDPSQSANLLAEAKKLNDAQAPK

SEQ ID NO: 364 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGGEIVYLPNLNAHQLCAFIRSLEDDRSQSANLLAEAKKLNDAQAPK

SEQ ID NO: 365 - protein, 107 aa, ARTIFICIAL SEQUENCE
  Engineered Abeta peptide binding polypeptide
AGGEIVYFRNLNADQLCAFIRSLEDDPSQNANLLAEAKKLNDAQAPASSSSGSSSSGRASAGGERVYLPNLNADQLCAFIRSLEDDPSQSANLLAEAKKLNDAQAPK

SEQ ID NO: 366 - protein, 107 aa, ARTIFICIAL SEQUENCE
  Engineered Abeta peptide binding polypeptide
AGGEIVYFPNLNADQLCAFIRSLEDDPSQNANLLAEAKKLNDAQAPASSSSGSSSSGRASAGGEIVYFPNLNADQLCAFIRSLEDDPSQSANLLAEAKKLNDAQAPK

SEQ ID NO: 367 - protein, 107 aa, ARTIFICIAL SEQUENCE
  Engineered Abeta peptide binding polypeptide
AGGEIVYFPNLNAHQLCAFIRSLEDDRSQSANLLAEAKKLNDAQAPASSSSGSSSSGRASAGGEIVYFPNLNADQLCAFIQSLEDDPSQSANLLAEAKKLNDAQAPK

SEQ ID NO: 368 - protein, 107 aa, ARTIFICIAL SEQUENCE
  Engineered Abeta peptide binding polypeptide
AGREYVYLPNLNADQLCAFIRSLEDDPSQSANLLAEAKKLNDAQAPASSSSGSSSSGRASAGGEIVYFPNLNADQLCAFIRSLEDDPSQSANLLAEAKKLNDAQAPK

SEQ ID NO: 369 - protein, 107 aa, ARTIFICIAL SEQUENCE
  Engineered Abeta peptide binding polypeptide
AGGEMVYLPNLNADQLCAFINSLEDDPSQSANLLAEAKKLNDAQAPASSSSGSSSSGRASAGGEIVYLPNLNAHQLCAFIRSLEDDPSQSANLLAEAKKLNDAQAPK

SEQ ID NO: 370 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGERVYLPNLNADQLCAFIRSLEDDPSQQANLLAEAKKLNDAQAPK

SEQ ID NO: 371 - protein, 107 aa, ARTIFICIAL SEQUENCE
  Engineered Abeta peptide binding polypeptide
AGGERVYLYNLNADQLCAFIRSLEDDESQSANLLAEAKKLNDAQAPASSSSGSSSSGRASAGGEIVYFPNLNADQLCAFIRSLEDDPSQNANLLAEAKKLNDAQAPK

SEQ ID NO: 372 - protein, 107 aa, ARTIFICIAL SEQUENCE
  Engineered Abeta peptide binding polypeptide
AGGEYVYLPNLNAHQLCAFIQSLEDDPSQSANLLAEAKKLNDAQAPASSSSGSSSSGRASAGGEIVYLPNLNADQLCAFIRSLEDDPSQSANLLAEAKKLNDAQAPK

SEQ ID NO: 373 - protein, 107 aa, ARTIFICIAL SEQUENCE
  Engineered Abeta peptide binding polypeptide
AGGERVYFPNLNADQLCAFIRSLEDDQSQSANLLAEAKKLNDAQAPASSSSGSSSSGRASAGGEIVYFPNLNADQLCAFIRSLEDDSSQSANLLAEAKKLNDAQAPK

SEQ ID NO: 374 - protein, 107 aa, ARTIFICIAL SEQUENCE
  Engineered Abeta peptide binding polypeptide
AGGEIVYLPNLNADQLCAFIRSLEDDPSQNANLLAEAKKLNDAQAPASSSSGSSSSGRASAGGEIVYLPNLNADQLCAFIQSLEDDPSQSANLLAEAKKLNDAQAPK

SEQ ID NO: 375 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEIVYLPNLNADQLCAFIQSLEDDESQNANLLAEAKKLNDAQAPK

SEQ ID NO: 376 - protein, 107 aa, ARTIFICIAL SEQUENCE
  Engineered Abeta peptide binding polypeptide
AGGEQVYLPNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 377 - protein, 107 aa, ARTIFICIAL SEQUENCE
  Engineered Abeta peptide binding polypeptide
AGGEYVYLPNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 378 - protein, 107 aa, ARTIFICIAL SEQUENCE
  Engineered Abeta peptide binding polypeptide
AGGEQVYLYNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 379 - protein, 107 aa, ARTIFICIAL SEQUENCE
  Engineered Abeta peptide binding polypeptide
AGGERVYLTNLNADQLCAFIQSLEDDPSQSANLLAEAKKLNDAQAPASSSSGSSSSGRASAGRERVYLPNLNADQLCAFIRSIEDDPSQQANLLAEAKKLNDAQAPK

SEQ ID NO: 380 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFIQSLEDDPSQRANLLAEAKKLNDAQAPK

SEQ ID NO: 381 - protein, 107 aa, ARTIFICIAL SEQUENCE
  Engineered Abeta peptide binding polypeptide
AGGEIVYFPNLNADQLCAFINSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 382 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGRERVYLPNLNADQLCAFIQSLEDDPSQRANLLAEAKKLNDAQAPK

SEQ ID NO: 383 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFIQSIEDDPSQRANLLAEAKKLNDAQAPK

SEQ ID NO: 384 - protein, 107 aa, ARTIFICIAL SEQUENCE
  Engineered Abeta peptide binding polypeptide
AGGERVYFTNLNADQLCAFIQSLEDDPSQSANLLAEAKKLNDAQAPASSSSGSSSSGRASAGREQVYLPNLNADQLCAFIRSLEDDPSQQANLLAEAKKLNDAQAPK

SEQ ID NO: 385 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 386 - protein, 107 aa, ARTIFICIAL SEQUENCE
  Engineered Abeta peptide binding polypeptide
AGGEIVYIPNLNADQLCAFIQSLEDDPSQQANLLAEAKKLNDAQAPASSSSGSSSSGRASAGRERVYLPNLNAHQLCAFIRSLEDDPSQSANLLAEAKKLNDAQAPK

SEQ ID NO: 387 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 388 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGGEMVYLPNLNAHQLCAFIQSLEDDPSQSANLLAEAKKLNDAQAPK

SEQ ID NO: 389 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGRERVYLPNLNADQLCAFIRSLEDDQSQQANLLAEAKKLNDAQAPK

SEQ ID NO: 390 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIQSLEDDQSQQANLLAEAKKLNDAQAPK

SEQ ID NO: 391 - protein, 107 aa, ARTIFICIAL SEQUENCE
  Engineered Abeta peptide binding polypeptide
AGGEIVYLPNLNAHQLCAFIQSLEDDPSQSANLLAEAKKLNDAQAPASSSSGSSSSGRASAGRERVYLPNLNADQLCAFINSLEDDRSQQANLLAEAKKLNDAQAPK

SEQ ID NO: 392 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNAHQLCAFIQSLEDDPSQQANLLAEAKKLNDAQAPK

SEQ ID NO: 393 - protein, 107 aa, ARTIFICIAL SEQUENCE
  Engineered Abeta peptide binding polypeptide
AGGERVYFPNLNADQLCAFIRSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 394 - protein, 107 aa, ARTIFICIAL SEQUENCE
  Engineered Abeta peptide binding polypeptide
AGGEYVYLPNLNADQLCAFIQSLEDDPSQSANLLAEAKKLNDAQAPASSSSGSSSSGRASAGGEIVYFPNLNAHQLCAFINSLEDDPSQSANLLAEAKKLNDAQAPK

SEQ ID NO: 395 - protein, 107 aa, ARTIFICIAL SEQUENCE
  Engineered Abeta peptide binding polypeptide
AGGEMVYLPNLNAHQLCAFIQSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 396 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 397 - protein, 107 aa, ARTIFICIAL SEQUENCE
  Engineered Abeta peptide binding polypeptide
AGGEIVYLPNLNAHQLCAFIRSLEDDPSQQANLLAEAKKLNDAQAPASSSSGSSSSGRASAGRERVYLPNLNADQLCAFIQSLEDDPSQQANLLAEAKKLNDAQAPK

SEQ ID NO: 398 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 399 - protein, 107 aa, ARTIFICIAL SEQUENCE
  Engineered Abeta peptide binding polypeptide
AGGEIHYFPNLNADQLCAFIRSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 400 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIRSLEDDRSQRANLLAEAKKLNDAQAPK

SEQ ID NO: 401 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSIEDDPSQQANLLAEAKKLNDAQAPK

SEQ ID NO: 402 - protein, 107 aa, ARTIFICIAL SEQUENCE
  Engineered Abeta peptide binding polypeptide
AGGEIHYFPNLNADQLCAFIRSLEDDPSQQANLLAEAKKLNDAQAPASSSSGSSSSGRASAGRERVYLPNLNAHQLCAFIRSLEDDPSQQANLLAEAKKLNDAQAPK

SEQ ID NO: 403 - protein, 107 aa, ARTIFICIAL SEQUENCE
  Engineered Abeta peptide binding polypeptide
AGGEIVYLPNLNAHQLCAFIRSLEDDPSQQANLLAEAKKLNDAQAPASSSSGSSSSGRASAGRERVYLPNLNAHQLCAFIRSLEDDPSQRANLLAEAKKLNDAQAPK

SEQ ID NO: 404 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGRERVYLPNLNADQLCAFIRSLEDDRSQRANLLAEAKKLNDAQAPK

SEQ ID NO: 405 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNAHQLCAFIQSIEDDPSQSANLLAEAKKLNDAQAPK

SEQ ID NO: 406 - protein, 107 aa, ARTIFICIAL SEQUENCE
  Engineered Abeta peptide binding polypeptide
AGGEIHYFPNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 407 - protein, 107 aa, ARTIFICIAL SEQUENCE
  Engineered Abeta peptide binding polypeptide
AGGERVYLPNLNADQLCAFIQSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 408 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGRERVYLPNLNADQLCAFIRSIEDDSSQQANLLAEAKKLNDAQAPK

SEQ ID NO: 409 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 410 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNADQLCAFIRSIEDDSSQQANLLAEAKKLNDAQAPK

SEQ ID NO: 411 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 412 - protein, 107 aa, ARTIFICIAL SEQUENCE
  Engineered Abeta peptide binding polypeptide
AGGERVYLPNLNADQLCAFIRSLEDDPSQQANLLAEAKKLNDAQAPASSSSGSSSSGRASAGRERVYLPNLNADQLCAFIRSLEDDRSQQANLLAEAKKLNDAQAPK

SEQ ID NO: 413 - protein, 107 aa, ARTIFICIAL SEQUENCE
  Engineered Abeta peptide binding polypeptide
AGGERVYLTNLNADQLCAFIRSLEDDPSQQANLLAEAKKLNDAQAPASSSSGSSSSGRASAGRERVYLPNLNADQLCAFIRSLEDDRSQQANLLAEAKKLNDAQAPK

SEQ ID NO: 414 - protein, 107 aa, ARTIFICIAL SEQUENCE
  Engineered Abeta peptide binding polypeptide
AGGEIVYLPNLNADQLCAFIQSLEDDPSQSANLLAEAKKLNDAQAPASSSSGSSSSGRASAGGEIVYFPNLNAHQLCAFIRSLEDDPSQSANLLAEAKKLNDAQAPK

SEQ ID NO: 415 - protein, 107 aa, ARTIFICIAL SEQUENCE
  Engineered Abeta peptide binding polypeptide
AGGERVYLPNLNADQLCAFIQSLEDDPSQQANLLAEAKKLNDAQAPASSSSGSSSSGRASAGRERVYLPNLNAHQLCAFIQSIEDDPSQSANLLAEAKKLNDAQAPK

SEQ ID NO: 416 - protein, 107 aa, ARTIFICIAL SEQUENCE
  Engineered Abeta peptide binding polypeptide
AGGEIVYLPNLNADQLCAFIQSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 417 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 418 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 419 - protein, 107 aa, ARTIFICIAL SEQUENCE
  Engineered Abeta peptide binding polypeptide
AGGERVYLTNLNADQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 420 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNAHQLCAFINSLEDDPSQSANLLAEAKKLNDAQAPK

SEQ ID NO: 421 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNAHQLCAFIQSLEDDPSQQANLLAEAKKLNDAQAPK

SEQ ID NO: 422 - protein, 107 aa, ARTIFICIAL SEQUENCE
  Engineered Abeta peptide binding polypeptide
AGGEIVYLPNLNAHQLCAFINSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 423 - protein, 107 aa, ARTIFICIAL SEQUENCE
  Engineered Abeta peptide binding polypeptide
AGGERVYLTNLNADQLCAFIRSLEDDPSQSANLLAEAKKLNDAQAPASSSSGSSSSGRASAGRERVYLPNLNADQLCAFIRSIEDDPSQQANLLAEAKKLNDAQAPK

SEQ ID NO: 424 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGRERVYLPNLNAHQLCAFIRSLEDDPSQSANLLAEAKKLNDAQAPK

SEQ ID NO: 425 - protein, 107 aa, ARTIFICIAL SEQUENCE
  Engineered Abeta peptide binding polypeptide
AGGEQVYFPNLNADQLCAFIQSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 426 - protein, 107 aa, ARTIFICIAL SEQUENCE
  Engineered Abeta peptide binding polypeptide
AGGEIVYLPNLNAHQLCAFIRSLEDDPSQQANLLAEAKKLNDAQAPASSSSGSSSSGRASAGRERVYLPNLNADQLCAFIRSLEDDRSQQANLLAEAKKLNDAQAPK

SEQ ID NO: 427 - protein, 107 aa, ARTIFICIAL SEQUENCE
  Engineered Abeta peptide binding polypeptide
AGGEIVYLPNLNADQLCAFINSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 428 - protein, 107 aa, ARTIFICIAL SEQUENCE
  Engineered Abeta peptide binding polypeptide
AGGEIVYFPNLNAHQLCAFIQSLEDDPSQQANLLAEAKKLNDAQAPASSSSGSSSSGRASAGRERVYLPNLNADQLCAFIRSIEDDPSQQANLLAEAKKLNDAQAPK

SEQ ID NO: 429 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEQVYLPNLNADQLCAFIRSLEDDRSQQANLLAEAKKLNDAQAPK

SEQ ID NO: 430 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNADQLCAFIQSLEDDQSQRANLLAEAKKLNDAQAPK

SEQ ID NO: 431 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIQSLEDDPSQSANLLAEAKKLNDAQAPK

SEQ ID NO: 432 - protein, 107 aa, ARTIFICIAL SEQUENCE
  Engineered Abeta peptide binding polypeptide
AGGEIVYIPNLNADQLCAFIRSLEDDPSQQANLLAEAKKLNDAQAPASSSSGSSSSGRASAGRERVYLPNLNADQLCAFIQSIEDDPSQSANLLAEAKKLNDAQAPK

SEQ ID NO: 433 - protein, 107 aa, ARTIFICIAL SEQUENCE
  Engineered Abeta peptide binding polypeptide
AGGEIVYFPNLNADQLCAFINSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 434 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGRERVYLTNLNADQLCAFINSLEDDPSQSANLLAEAKKLNDAQAPK

SEQ ID NO: 435 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFIQSLEDDRSQRANLLAEAKKLNDAQAPK

SEQ ID NO: 436 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGREQVYLPNLNADQLCAFIQSIEDDPSQSANLLAEAKKLNDAQAPK

SEQ ID NO: 437 - protein, 107 aa, ARTIFICIAL SEQUENCE
  Engineered Abeta peptide binding polypeptide
AGGEQVYFPNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 438 - protein, 107 aa, ARTIFICIAL SEQUENCE
  Engineered Abeta peptide binding polypeptide
AGGERVYLPNLNADQLCAFIRSLEDDPSQSANLLAEAKKLNDAQAPASSSSGSSSSGRASAGRERVYLPNLNADQLCAFINSLEDDPSQQANLLAEAKKLNDAQAPK

SEQ ID NO: 439 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIQSIEDDRSQRANLLAEAKKLNDAQAPK

SEQ ID NO: 440 - protein, 107 aa, ARTIFICIAL SEQUENCE
  Engineered Abeta peptide binding polypeptide
AGGERVYLTNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 441 - protein, 107 aa, ARTIFICIAL SEQUENCE
  Engineered Abeta peptide binding polypeptide
AGGERVYLTNLNADQLCAFIQSLEDDPSQSANLLAEAKKLNDAQAPASSSSGSSSSGRASAGREQVYLPNLNADQLCAFIRSLEDDPSQQANLLAEAKKLNDAQAPK

SEQ ID NO: 442 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 443 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFINSIEDDPSQQANLLAEAKKLNDAQAPK

SEQ ID NO: 444 - protein, 107 aa, ARTIFICIAL SEQUENCE
  Engineered Abeta peptide binding polypeptide
AGGEIVYLPNLNADQLCAFIRSLEDDPSQQANLLAEAKKLNDAQAPASSSSGSSSSGRASAGRERVYLPNLNADQLCAFIQSLEDDPSQSANLLAEAKKLNDAQAPK

SEQ ID NO: 445 - protein, 107 aa, ARTIFICIAL SEQUENCE
  Engineered Abeta peptide binding polypeptide
AGGERVYLPNLNADQLCAFINSLEDDPSQSANLLAEAKKLNDAQAPASSSSGSSSSGRASAGREQVYLPNLNAHQLCAFIRSIEDDPSQSANLLAEAKKLNDAQAPK

SEQ ID NO: 446 - protein, 107 aa, ARTIFICIAL SEQUENCE
  Engineered Abeta peptide binding polypeptide
AGGEYVYLPNLNADQLCAFIQSLEDDPSQSANLLAEAKKLNDAQAPASSSSGSSSSGRASAGRERVYLPNLNAHQLCAFIRSLEDDPSQRANLLAEAKKLNDAQAPK

SEQ ID NO: 447 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFINSLEDDPSQQANLLAEAKKLNDAQAPK

SEQ ID NO: 448 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNAHQLCAFIQSLEDDPSQQANLLAEAKKLNDAQAPK

SEQ ID NO: 449 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 450 - protein, 107 aa, ARTIFICIAL SEQUENCE
  Engineered Abeta peptide binding polypeptide
AGGEQVYFPNLNADQLCAFIRSLEDDPSQSANLLAEAKKLNDAQAPASSSSGSSSSGRASAGRERVYLPNLNADQLCAFIQSLEDDPSQRANLLAEAKKLNDAQAPK

SEQ ID NO: 451 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNAHQLCAIIRSLEDDPSQQANLLAEAKKLNDAQAPK

SEQ ID NO: 452 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIQSLEDDQSQQANLLAEAKKLNDAQAPK

SEQ ID NO: 453 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 454 - protein, 107 aa, ARTIFICIAL SEQUENCE
  Engineered Abeta peptide binding polypeptide
AGGERVYLTNLNADQLCAFIRSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 455 - protein, 107 aa, ARTIFICIAL SEQUENCE
  Engineered Abeta peptide binding polypeptide
AGGERVYLPNLNAHQLCAFIRSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 456 - protein, 107 aa, ARTIFICIAL SEQUENCE
  Engineered Abeta peptide binding polypeptide
AGGERVYLTNLNADQLCAFIRSLEDDPSQQANLLAEAKKLNDAQAPASSSSGSSSSGRASAGRERVYLPNLNADQLCAFIQSLEDDPSQRANLLAEAKKLNDAQAPK

SEQ ID NO: 457 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 458 - protein, 107 aa, ARTIFICIAL SEQUENCE
  Engineered Abeta peptide binding polypeptide
AGGERVYLRNLNADQLCAFINSLEDDPSQSANLLAEAKKLNDAQAPASSSSGSSSSGRASAGREIVYLPNLNAHQLCAFIRSLEDDPSQQANLLAEAKKLNDAQAPK

SEQ ID NO: 459 - protein, 107 aa, ARTIFICIAL SEQUENCE
  Engineered Abeta peptide binding polypeptide
AGGEMVYLPNLNADQLCAFINSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 460 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 461 - protein, 107 aa, ARTIFICIAL SEQUENCE
  Engineered Abeta peptide binding polypeptide
AGGERVYFTNLNADQLCAFIQSLEDDPSQSANLLAEAKKLNDAQAPASSSSGSSSSGRASAGRERVYLPNLNADQLCAFIRSIEDDPSQQANLLAEAKKLNDAQAPK

SEQ ID NO: 462 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSIEDDPSQRANLLAEAKKLNDAQAPK

SEQ ID NO: 463 - protein, 107 aa, ARTIFICIAL SEQUENCE
  Engineered Abeta peptide binding polypeptide
AGGERVYFTNLNADQLCAFIRSLEDDPSQQANLLAEAKKLNDAQAPASSSSGSSSSGRASAGRERVYLPNLNADQLCAFIQSLEDDPSQQANLLAEAKKLNDAQAPK

SEQ ID NO: 464 - protein, 107 aa, ARTIFICIAL SEQUENCE
  Engineered Abeta peptide binding polypeptide
AGGEIVYLPNLNADQLCAFIRSLEDDPSQQANLLAEAKKLNDAQAPASSSSGSSSSGRASAGREQVYLPNLNADQLCAFIRSLEDDPSQQANLLAEAKKLNDAQAPK

SEQ ID NO: 465 - protein, 107 aa, ARTIFICIAL SEQUENCE
  Engineered Abeta peptide binding polypeptide
AGGERVYLPNLNADQLCAFIRSLEDDPSQQANLLAEAKKLNDAQAPASSSSGSSSSGRASAGRERVYLPNLNADQLCAFIQSLEDDPSQQANLLAEAKKLNDAQAPK

SEQ ID NO: 466 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGRERVYLPNLNADQLCAFIRSFEDDRSQQANLLAEAKKLNDAQAPK

SEQ ID NO: 467 - protein, 107 aa, ARTIFICIAL SEQUENCE
  Engineered Abeta peptide binding polypeptide
AGGEIHYFPNLNADQLCAFIRSLEDDPSQSANLLAEAKKLNDAQAPASSSSGSSSSGRASAGRERVYLPNLNADQLCAFIQSLEDDRSQQANLLAEAKKLNDAQAPK

SEQ ID NO: 468 - protein, 107 aa, ARTIFICIAL SEQUENCE
  Engineered Abeta peptide binding polypeptide
AGGERVYFPNLNADQLCAFIRSLEDDPSQSANLLAEAKKLNDAQAPASSSSGSSSSGRASAGRERVYLPNLNADQLCAFINSLEDDPSQQANLLAEAKKLNDAQAPK

SEQ ID NO: 469 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNADQLCAFIQSLEDDRSQRANLLAEAKKLNDAQAPK

SEQ ID NO: 470 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFINSIEDDPSQQANLLAEAKKLNDAQAPK

SEQ ID NO: 471 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGRERVYLPNLNADQLCAFIQSLEDDPSQRANLLAEAKKLNDAQAPK

SEQ ID NO: 472 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGGEIVYLPNLNADQLCAFIRSLEDDPSQSANLLAEAKKLNDAQAPK

SEQ ID NO: 473 - protein, 107 aa, ARTIFICIAL SEQUENCE
  Engineered Abeta peptide binding polypeptide
AGGEIHYFPNLNAHQLCAFIQSLEDDPSQSANLLAEAKKLNDAQAPASSSSGSSSSGRASAGRERVYLPNLNADQLCAFINSLEDDPSQQANLLAEAKKLNDAQAPK

SEQ ID NO: 474 - protein, 107 aa, ARTIFICIAL SEQUENCE
  Engineered Abeta peptide binding polypeptide
AGGEYVYLPNLNADQLCAFIQSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 475 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGGEQVYLPNLNADQLCAFIRSLEDDPSQSANLLAEAKKLNDAQAPK

SEQ ID NO: 476 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNAHQLCAFIQSIEDDPSQSANLLAEAKKLNDAQAPK

SEQ ID NO: 477 - protein, 107 aa, ARTIFICIAL SEQUENCE
  Engineered Abeta peptide binding polypeptide
AGGERVYLRNLNADQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 478 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 479 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGRERVYLPNLNADQLCAFIQSIEDDPSQQANLLAEAKKLNDAQAPK

SEQ ID NO: 480 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 481 - protein, 107 aa, ARTIFICIAL SEQUENCE
  Engineered Abeta peptide binding polypeptide
AGGEIVYFPNLNAHQLCAFIQSLEDDPSQQANLLAEAKKLNDAQAPASSSSGSSSSGRASAGRERVYLPNLNADQLCAFINSLEDDSSQQANLLAEAKKLNDAQAPK

SEQ ID NO: 482 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIQSLEDDPSQQANLLAEAKKLNDAQAPK

SEQ ID NO: 483 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGGEQVYLPNLNADQLCAFIRSLEDDPSQSANLLAEAKKLNDAQAPK

SEQ ID NO: 484 - protein, 107 aa, ARTIFICIAL SEQUENCE
  Engineered Abeta peptide binding polypeptide
AGGERVYLTNLNADQLCAFIQSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 485 - protein, 107 aa, ARTIFICIAL SEQUENCE
  Engineered Abeta peptide binding polypeptide
AGGERVYLTNLNADQLCAFIQSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 486 - protein, 107 aa, ARTIFICIAL SEQUENCE
  Engineered Abeta peptide binding polypeptide
AGGEYVYLPNLNAHQLCAFIRSLEDDPSQQANLLAEAKKLNDAQAPASSSSGSSSSGRASAGRERVYLPNLNADQLCAFIRSLEDDPSQSANLLAEAKKLNDAQAPK

SEQ ID NO: 487 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNADQLCAFIQSFEDDPSQRANLLAEAKKLNDAQAPK

SEQ ID NO: 488 - protein, 107 aa, ARTIFICIAL SEQUENCE
  Engineered Abeta peptide binding polypeptide
AGGERVYFTNLNADQLCAFIQSLEDDPSQSANLLAEAKKLNDAQAPASSSSGSSSSGRASAGRERVYLPNLNADQLCAFINSIEDDPSQQANLLAEAKKLNDAQAPK

SEQ ID NO: 489 - protein, 107 aa, ARTIFICIAL SEQUENCE
  Engineered Abeta peptide binding polypeptide
AGGERVYLPNLNADQLCAFIQSLEDDPSQQANLLAEAKKLNDAQAPASSSSGSSSSGRASAGRERVYLPNLNAHQLCAFIRSIEDDPSQRANLLAEAKKLNDAQAPK

SEQ ID NO: 490 - protein, 107 aa, ARTIFICIAL SEQUENCE
  Engineered Abeta peptide binding polypeptide
AGGEIVYFPNLNADQLCAFINSLEDDPSQSANLLAEAKKLNDAQAPASSSSGSSSSGRASAGRERVYLPNLNAHQLCAFIRSIEDDRSQRANLLAEAKKLNDAQAPK

SEQ ID NO: 491 - protein, 107 aa, ARTIFICIAL SEQUENCE
  Engineered Abeta peptide binding polypeptide
AGRERVYLPNLNAHQLCAFIRSLEDDPSQSANLLAEAKKLNDAQAPASSSSGSSSSGRASAGRERVYLPNLNADQLCAFIRSIEDDPSQRANLLAEAKKLNDAQAPK

SEQ ID NO: 492 - protein, 107 aa, ARTIFICIAL SEQUENCE
  Engineered Abeta peptide binding polypeptide
AGGERVYLYNLNADQLCAFIRSLEDDPSQSANLLAEAKKLNDAQAPASSSSGSSSSGRASAGRERVYLPNLNADQLCAFIQSLEDDPSQQANLLAEAKKLNDAQAPK

SEQ ID NO: 493 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGREIVYLPNLNADQLCAFIRSLEDDRSQQANLLAEAKKLNDAQAPK

SEQ ID NO: 494 - protein, 107 aa, ARTIFICIAL SEQUENCE
  Engineered Abeta peptide binding polypeptide
AGGERVYFPNLNAHQLCAFIRSLEDDPSQSANLLAEAKKLNDAQAPASSSSGSSSSGRASAGREQVYLPNLNADQLCAFIQSLEDDPSQQANLLAEAKKLNDAQAPK

SEQ ID NO: 495 - protein, 107 aa, ARTIFICIAL SEQUENCE
  Engineered Abeta peptide binding polypeptide
AGGERVYFTNLNADQLCAFIQSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 496 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGRERVYLPNLNADQLCAFIRSLEDDPSQRANLLAEAKKLNDAQAPK

SEQ ID NO: 497 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSIEDDSSQQANLLAEAKKLNDAQAPK

SEQ ID NO: 498 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 499 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGGEMVYLPNLNAHQLCAFIQSLEDDPSQSANLLAEAKKLNDAQAPK

SEQ ID NO: 500 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGGEQVYLPNLNADQLCAFIQSLEDDPSQRANLLAEAKKLNDAQAPK

SEQ ID NO: 501 - protein, 107 aa, ARTIFICIAL SEQUENCE
  Engineered Abeta peptide binding polypeptide
AGGEIVYLPNLNAHQLCAFIRSLEDDPSQQANLLAEAKKLNDAQAPASSSSGSSSSGRASAGRERVYLPNLNAHQLCAFIQSIEDDPSQSANLLAEAKKLNDAQAPK

SEQ ID NO: 502 - protein, 107 aa, ARTIFICIAL SEQUENCE
  Engineered Abeta peptide binding polypeptide
AGGEIHYFPNLNAHQLCAFIQSLEDDPSQQANLLAEAKKLNDAQAPASSSSGSSSSGRASAGRERVYLPNLNAHQLCAFIRSLEDDRSQQANLLAEAKKLNDAQAPK

SEQ ID NO: 503 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFINSLEDDPSQQANLLAEAKKLNDAQAPK

SEQ ID NO: 504 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAFIQSLEDDPSQQANLLAEAKKLNDAQAPK

SEQ ID NO: 505 - protein, 107 aa, ARTIFICIAL SEQUENCE
  Engineered Abeta peptide binding polypeptide
AGGEIVYFPNLNADQLCAFINSLEDDPSQQANLLAEAKKLNDAQAPASSSSGSSSSGRASAGRERVYLPNLNAHQLCAFIRSIEDDSSQQANLLAEAKKLNDAQAPK

SEQ ID NO: 506 - protein, 107 aa, ARTIFICIAL SEQUENCE
  Engineered Abeta peptide binding polypeptide
AGGERVYFTNLNADQLCAFIRSLEDDPSQQANLLAEAKKLNDAQAPASSSSGSSSSGRASAGRERVYLPNLNADQLCAFIRSIEDDPSQRANLLAEAKKLNDAQAPK

SEQ ID NO: 507 - protein, 107 aa, ARTIFICIAL SEQUENCE
  Engineered Abeta peptide binding polypeptide
AGGEQVYLTNLNADQLCAFIRSLEDDPSQSANLLAEAKKLNDAQAPASSSSGSSSSGRASAGRERVYLPNLNADQLCAFIRSLEDDPSQQANLLAEAKKLNDAQAPK

SEQ ID NO: 508 - protein, 107 aa, ARTIFICIAL SEQUENCE
  Engineered Abeta peptide binding polypeptide
AGGEIVYLPNLNADQLCAFIQSLEDDPSQQANLLAEAKKLNDAQAPASSSSGSSSSGRASAGGEIVYFPNLNAHQLCAFIRSLEDDPSQSANLLAEAKKLNDAQAPK

SEQ ID NO: 509 - protein, 107 aa, ARTIFICIAL SEQUENCE
  Engineered Abeta peptide binding polypeptide
AGGEIHYFPNLNADQLCAFIRSLEDDPSQQANLLAEAKKLNDAQAPASSSSGSSSSGRASAGRERVYLPNLNAHQLCAFIRSLEDDSSQQANLLAEAKKLNDAQAPK

SEQ ID NO: 510 - protein, 107 aa, ARTIFICIAL SEQUENCE
  Engineered Abeta peptide binding polypeptide
AGGEIHYFPNLNADQLCAFIQSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 511 - protein, 107 aa, ARTIFICIAL SEQUENCE
  Engineered Abeta peptide binding polypeptide
AGGERVYLPNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 512 - protein, 107 aa, ARTIFICIAL SEQUENCE
  Engineered Abeta peptide binding polypeptide
AGGEIHYFPNLNAHQLCAFIRSLEDDPSQQANLLAEAKKLNDAQAPASSSSGSSSSGRASAGRERVYLPNLNAHQLCAFIQSLEDDRSQQANLLAEAKKLNDAQAPK

SEQ ID NO: 513 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNADQLCAFIQSIEDDPSQSANLLAEAKKLNDAQAPK

SEQ ID NO: 514 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNADQLCAIIRSLEDDQSQQANLLAEAKKLNDAQAPK

SEQ ID NO: 515 - protein, 107 aa, ARTIFICIAL SEQUENCE
  Engineered Abeta peptide binding polypeptide
AGGEQVYLPNLNADQLCAFIRSLEDDPSQSANLLAEAKKLNDAQAPASSSSGSSSSGRASAGREIVYLPNLNADQLCAFIRSLEDDRSQQANLLAEAKKLNDAQAPK

SEQ ID NO: 516 - protein, 107 aa, ARTIFICIAL SEQUENCE
  Engineered Abeta peptide binding polypeptide
AGGEIHYFPNLNADQLCAFIRSLEDDPSQQANLLAEAKKLNDAQAPASSSSGSSSSGRASAGRERVYLPNLNADQLCAFIRSLEDDPSQQANLLAEAKKLNDAQAPK

SEQ ID NO: 517 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSLEDDQSQQANLLAEAKKLNDAQAPK

SEQ ID NO: 518 - protein, 107 aa, ARTIFICIAL SEQUENCE
  Engineered Abeta peptide binding polypeptide
AGGEIVYFPNLNAHQLCAFIRSLEDDPSQSANLLAEAKKLNDAQAPASSSSGSSSSGRASAGRERVYLPNLNAHQLCAFIRSIEDDPSQQANLLAEAKKLNDAQAPK

SEQ ID NO: 519 - protein, 107 aa, ARTIFICIAL SEQUENCE
  Engineered Abeta peptide binding polypeptide
AGGERVYFPNLNADQLCAFIQSLEDDPSQSANLLAEAKKLNDAQAPASSSSGSSSSGRASAGRERVYLPNLNAHQLCAFIRSLEDDPSQRANLLAEAKKLNDAQAPK

SEQ ID NO: 520 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGRERVYLPNLNADQLCAFIQSLEDDPSQSANLLAEAKKLNDAQAPK

SEQ ID NO: 521 - protein, 107 aa, ARTIFICIAL SEQUENCE
  Engineered Abeta peptide binding polypeptide
AGGEIVYLPNLNAHQLCAFINSLEDDPSQSANLLAEAKKLNDAQAPASSSSGSSSSGRASAGRERVYLPNLNADQLCAFIRSIEDDPSQSANLLAEAKKLNDAQAPK

SEQ ID NO: 522 - protein, 107 aa, ARTIFICIAL SEQUENCE
  Engineered Abeta peptide binding polypeptide
AGGEIVYFPNLNAHQLCAFIQSLEDDPSQSANLLAEAKKLNDAQAPASSSSGSSSSGRASAGRERVYLPNLNAHQLCAFIRSLEDDRSQQANLLAEAKKLNDAQAPK

SEQ ID NO: 523 - protein, 107 aa, ARTIFICIAL SEQUENCE
  Engineered Abeta peptide binding polypeptide
AGGEMVYFPNLNADQLCAFIQSLEDDPSQSANLLAEAKKLNDAQAPASSSSGSSSSGRASAGRERVYLPNLNAHQLCAFIRSLEDDRSQQANLLAEAKKLNDAQAPK

SEQ ID NO: 524 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGRERVYLPNLNAHQLCAFIRSLEDDPSQRANLLAEAKKLNDAQAPK

SEQ ID NO: 525 - protein, 107 aa, ARTIFICIAL SEQUENCE
  Engineered Abeta peptide binding polypeptide
AGGEIHYFPNLNADQLCAFIQSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 526 - protein, 107 aa, ARTIFICIAL SEQUENCE
  Engineered Abeta peptide binding polypeptide
AGGERVYLTNLNAHQLCAFIQSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 527 - protein, 107 aa, ARTIFICIAL SEQUENCE
  Engineered Abeta peptide binding polypeptide
AGGEIVYLPNLNAHQLCAFINSLEDDPSQSANLLAEAKKLNDAQAPASSSSGSSSSGRASAGGEQVYLPNLNADQLCAFIRSLEDDPSQSANLLAEAKKLNDAQAPK

SEQ ID NO: 528 - protein, 107 aa, ARTIFICIAL SEQUENCE
  Engineered Abeta peptide binding polypeptide
AGGEIVYLPNLNADQLCAFIRSLEDDPSQQANLLAEAKKLNDAQAPASSSSGSSSSGRASAGREQVYLPNLNADQLCAFIRSLEDDPSQSANLLAEAKKLNDAQAPK

SEQ ID NO: 529 - protein, 107 aa, ARTIFICIAL SEQUENCE
  Engineered Abeta peptide binding polypeptide
AGGEQVYFTNLNAHQLCAFIRSLEDDPSQQANLLAEAKKLNDAQAPASSSSGSSSSGRASAGRERVYLPNLNADQLCAFINSIEDDPSQSANLLAEAKKLNDAQAPK

SEQ ID NO: 530 - protein, 107 aa, ARTIFICIAL SEQUENCE
  Engineered Abeta peptide binding polypeptide
AGGEIVYLPNLNADQLCAFIRSLEDDPSQQANLLAEAKKLNDAQAPASSSSGSSSSGRASAGRERVYLPNLNADQLCAFINSIEDDPSQSANLLAEAKKLNDAQAPK

SEQ ID NO: 531 - protein, 107 aa, ARTIFICIAL SEQUENCE
  Engineered Abeta peptide binding polypeptide
AGGEQVYFPNLNADQLCAFIRSLEDDPSQSANLLAEAKKLNDAQAPASSSSGSSSSGRASAGRERVYLPNLNADQLCAFIRSLEDDRSQQANLLAEAKKLNDAQAPK

SEQ ID NO: 532 - protein, 107 aa, ARTIFICIAL SEQUENCE
  Engineered Abeta peptide binding polypeptide
AGGEIHYFPNLNADQLCAFIRSLEDDPSQSANLLAEAKKLNDAQAPASSSSGSSSSGRASAGRERVYLPNLNADQLCAFIRSLEDDQSQRANLLAEAKKLNDAQAPK

SEQ ID NO: 533 - protein, 107 aa, ARTIFICIAL SEQUENCE
  Engineered Abeta peptide binding polypeptide
AGGEQVYFRNLNADQLCAFIRSLEDDPSQQANLLAEAKKLNDAQAPASSSSGSSSSGRASAGRERVYLPNLNADQLCAFIRSLEDDPSQRANLLAEAKKLNDAQAPK

SEQ ID NO: 534 - protein, 107 aa, ARTIFICIAL SEQUENCE
  Engineered Abeta peptide binding polypeptide
AGGEIVYFPNLNAHQLCAFIRSLEDDPSQQANLLAEAKKLNDAQAPASSSSGSSSSGRASAGRERVYLPNLNADQLCAFIQSLEDDPSQRANLLAEAKKLNDAQAPK

SEQ ID NO: 535 - protein, 107 aa, ARTIFICIAL SEQUENCE
  Engineered Abeta peptide binding polypeptide
AGGERVYLTNLNAHQLCAFIRSLEDDPSQQANLLAEAKKLNDAQAPASSSSGSSSSGRASAGRERVYLPNLNADQLCAFIRSLEDDRSQQANLLAEAKKLNDAQAPK

SEQ ID NO: 536 - protein, 107 aa, ARTIFICIAL SEQUENCE
  Engineered Abeta peptide binding polypeptide
AGGEIVYLPNLNAHQLCAFIQSLEDDPSQSANLLAEAKKLNDAQAPASSSSGSSSSGRASAGRERVYLPNLNAHQLCAFIRSLEDDPSQRANLLAEAKKLNDAQAPK

SEQ ID NO: 537 - protein, 107 aa, ARTIFICIAL SEQUENCE
  Engineered Abeta peptide binding polypeptide
AGGEIVYLPNLNAHQLCAFIRSLEDDPSQSANLLAEAKKLNDAQAPASSSSGSSSSGRASAGRERVYLPNLNAHQLCAFIRSLEDDPSQQANLLAEAKKLNDAQAPK

SEQ ID NO: 538 - protein, 107 aa, ARTIFICIAL SEQUENCE
  Engineered Abeta peptide binding polypeptide
AGGEIVYFPNLNADQLCAFIRSLEDDPSQSANLLAEAKKLNDAQAPASSSSGSSSSGRASAGRERVYLPNLNADQLCAFIRSLEDDESQQANLLAEAKKLNDAQAPK

SEQ ID NO: 539 - protein, 107 aa, ARTIFICIAL SEQUENCE
  Engineered Abeta peptide binding polypeptide
AGGERVYLPNLNADQLCAFINSLEDDPSQQANLLAEAKKLNDAQAPASSSSGSSSSGRASAGRERVYLPNLNAHQLCAFIQSLEDDPSQSANLLAEAKKLNDAQAPK

SEQ ID NO: 540 - protein, 107 aa, ARTIFICIAL SEQUENCE
  Engineered Abeta peptide binding polypeptide
AGGEIVYFPNLNADQLCAFIRSLEDDPSQQANLLAEAKKLNDAQAPASSSSGSSSSGRASAGRERVYLPNLNAHQLCAFIQSLEDDRSQQANLLAEAKKLNDAQAPK

SEQ ID NO: 541 - protein, 107 aa, ARTIFICIAL SEQUENCE
  Engineered Abeta peptide binding polypeptide
AGGEIVYLPNLNADQLCAFIRSLEDDPSQSANLLAEAKKLNDAQAPASSSSGSSSSGRASAGRERVYLPNLNAHQLCAFIQSLEDDPSQQANLLAEAKKLNDAQAPK

SEQ ID NO: 542 - protein, 107 aa, ARTIFICIAL SEQUENCE
  Engineered Abeta peptide binding polypeptide
AGGEIVYFPNLNADQLCAFIQSLEDDPSQQANLLAEAKKLNDAQAPASSSSGSSSSGRASAGRERVYLPNLNADQLCAFIRSIEDDSSQRANLLAEAKKLNDAQAPK

SEQ ID NO: 543 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNAHQLCAFIRSLEDDPSQRANLLAEAKKLNDAQAPK

SEQ ID NO: 544 - protein, 107 aa, ARTIFICIAL SEQUENCE
  Engineered Abeta peptide binding polypeptide
AGGERVYLTNLNADQLCAFIQSLEDDPSQQANLLAEAKKLNDAQAPASSSSGSSSSGRASAGRERVYLPNLNADQLCAFIQSIEDDSSQQANLLAEAKKLNDAQAPK

SEQ ID NO: 545 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGGERVYLPNLNADQLCAFINSLEDDRSQSANLLAEAKKLNDAQAPK

SEQ ID NO: 546 - protein, 107 aa, ARTIFICIAL SEQUENCE
  Engineered Abeta peptide binding polypeptide
AGGEIVYLPNLNAHQLCAFIRSLEDDPSQQANLLAEAKKLNDAQAPASSSSGSSSSGRASAGRERVYLPNLNAHQLCAFIQSLEDDPSQQANLLAEAKKLNDAQAPK

SEQ ID NO: 547 - protein, 107 aa, ARTIFICIAL SEQUENCE
  Engineered Abeta peptide binding polypeptide
AGGERVYLTNLNADQLCAFINSLEDDPSQSANLLAEAKKLNDAQAPASSSSGSSSSGRASAGRERVYLPNLNADQLCAFINSIEDDPSQSANLLAEAKKLNDAQAPK

SEQ ID NO: 548 - protein, 107 aa, ARTIFICIAL SEQUENCE
  Engineered Abeta peptide binding polypeptide
AGGERVYLPNLNADQLCAFIQSLEDDPSQSANLLAEAKKLNDAQAPASSSSGSSSSGRASAGRERVYLPNLNADQLCAFIRSLEDDPSQSANLLAEAKKLNDAQAPK

SEQ ID NO: 549 - protein, 107 aa, ARTIFICIAL SEQUENCE
  Engineered Abeta peptide binding polypeptide
AGGEIVYFPNLNADQLCAFIQSLEDDPSQSANLLAEAKKLNDAQAPASSSSGSSSSGRASAGRERVYLPNLNADQLCAFIRSLEDDSSQRANLLAEAKKLNDAQAPK

SEQ ID NO: 550 - protein, 107 aa, ARTIFICIAL SEQUENCE
  Engineered Abeta peptide binding polypeptide
AGGEMVYLPNLNADQLCAFINSLEDDPSQQANLLAEAKKLNDAQAPASSSSGSSSSGRASAGRERVYLPNLNADQLCAFIRSIEDDPSQSANLLAEAKKLNDAQAPK

SEQ ID NO: 551 - protein, 107 aa, ARTIFICIAL SEQUENCE
  Engineered Abeta peptide binding polypeptide
AGGERVYLPNLNADQLCAFIRSLEDDPSQSANLLAEAKKLSEAQAPASSSSGSSSSGRASAGGERVYLPNLNADQLCAFIRSLEDDPSQSANLLAEAKKLSEAQAPK

SEQ ID NO: 552 - protein, 107 aa, ARTIFICIAL SEQUENCE
  Engineered Abeta peptide binding polypeptide
AGGERVYLPNLNADQLCAFIRSLEDDPSQSSELLSEAKKLSESQAPASSSSGSSSSGRASAGGERVYLPNLNADQLCAFIRSLEDDPSQSSELLSEAKKLSESQAPK

SEQ ID NO: 553 - protein, 107 aa, ARTIFICIAL SEQUENCE
  Engineered Abeta peptide binding polypeptide
AGGERVYLPNLTADQLCAFIRKLEDDPSQSSELLSEAKKLSESQAPASSSSGSSSSGRASAGGERVYLPNLTADQLCAFIRKLEDDPSQSSELLSEAKKLSESQAPK

SEQ ID NO: 554 - protein, 58 aa, ARTIFICIAL SEQUENCE
  Engineered Abeta binding polypeptide
VDNKFNKEGKGAPGEIHYLPNLNADQLCAFIRSLEDDPSQSANLLAEAKKLNDAQAPK

SEQ ID NO: 555 - protein, 58 aa, ARTIFICIAL SEQUENCE
  Engineered Abeta binding polypeptide
VDNKFNKEIEVATGEIVYLPNLNADQLCAFINSLEDDPSQSANLLAEAKKLNDAQAPK

SEQ ID NO: 556 - DNA, 278 bp, ARTIFICIAL SEQUENCE
  Library oligonucleotide
  misc_feature (13)..(18): n is a, c, g, or t
  misc_feature (22)..(27): n is a, c, g, or t
  misc_feature (40)..(42): n is a, c, g, or t
  misc_feature (61)..(63): n is a, c, g, or t
  misc_feature (88)..(90): n is a, c, g, or t
  misc_feature (193)..(195): n is a, c, g, or t
  misc_feature (205)..(207): n is a, c, g, or t
  misc_feature (220)..(222): n is a, c, g, or t
  misc_feature (235)..(237): n is a, c, g, or t
  misc_feature (241)..(243): n is a, c, g, or t
  misc_feature (247)..(249): n is a, c, g, or t
  misc_feature (259)..(261): n is a, c, g, or t
  misc_feature (268)..(270): n is a, c, g, or t
gcgggtggggagnnnnnntatnnnnnnaacttaaacgcgnnncaactgtgtgccttcatcnnnagtttagaagatgacccaagccaannngctaacttgttggcagaagctaaaaagctaaatgatgctcaggcgccggcgagcagcagcagcgggagcagcagcagcgggcgcgcgagtgcgggtcgcgagnnngtttatttannnaacttaaacgcgnnncaactgtgtgccnnnatcnnnagtnnngaagatgacnnnagccaannngctaactt

SEQ ID NO: 557 - DNA, 278 bp, ARTIFICIAL SEQUENCE
  Library oligonucleotide
  misc_feature (7)..(9): n is a, c, g, or t
  misc_feature (13)..(15): n is a, c, g, or t
  misc_feature (22)..(27): n is a, c, g, or t
  misc_feature (40)..(42): n is a, c, g, or t
  misc_feature (61)..(63): n is a, c, g, or t
  misc_feature (79)..(81): n is a, c, g, or t
  misc_feature (88)..(90): n is a, c, g, or t
  misc_feature (187)..(189): n is a, c, g, or t
  misc_feature (193)..(195): n is a, c, g, or t
  misc_feature (202)..(207): n is a, c, g, or t
  misc_feature (220)..(222): n is a, c, g, or t
  misc_feature (241)..(243): n is a, c, g, or t
  misc_feature (259)..(261): n is a, c, g, or t
  misc_feature (268)..(270): n is a, c, g, or t
gcgggtnnngagnnngtttatnnnnnnaacttaaacgcgnnncaactgtgtgccttcatcnnnagtttagaagatgacnnnagccaannngctaacttgttggcagaagctaaaaagctaaatgatgctcaggcgccggcgagcagcagcagcgggagcagcagcagcgggcgcgcgagtgcgggtnnngagnnngtttatnnnnnnaacttaaacgcgnnncaactgtgtgccttcatcnnnagtttagaagatgacnnnagccaannngctaactt

SEQ ID NO: 558 - protein, 22 aa, artificial sequence
  Engineered polypeptide
  MISC_FEATURE (2)..(2): X2 is selected from I, M, Q, R and Y
  MISC_FEATURE (3)..(3): X3 is selected from H and V
  MISC_FEATURE (5)..(5): X5 is selected from F, I and L
  MISC_FEATURE (6)..(6): X6 is selected from P and T
  MISC_FEATURE (9)..(9): X9 is selected from N and T
  MISC_FEATURE (11)..(11): X11 is selected from D and H
  misc_feature (16)..(16): Xaa can be any naturally occurring amino acid
  MISC_FEATURE (18)..(18): X18 is selected from N, Q and R
  MISC_FEATURE (19)..(19): X19 is selected from K and S
  misc_feature (20)..(20): Xaa can be any naturally occurring amino acid
EXXYXXNLXAXQLCAXIXXXED

SEQ ID NO: 559 - protein, 22 aa, Artificial Sequence
  Engineered polypeptide
  MISC_FEATURE (2)..(2): X2 is selected from I, M and R
  MISC_FEATURE (5)..(5): X5 is selected from F, I and L
  MISC_FEATURE (6)..(6): X6 is selected from P and T
  MISC_FEATURE (11)..(11): X11 is selected from D and H
  MISC_FEATURE (18)..(18): X18 is selected from N, Q and R
EXVYXXNLNAXQLCAFIXSLED

SEQ ID NO: 560 - protein, 22 aa, artificial sequence
  Engineered polypeptide
  MISC_FEATURE (2)..(2): X2 is selected from I, M, Q, R and T
  MISC_FEATURE (5)..(5): X5 is selected from F and L
  MISC_FEATURE (9)..(9): X9 is selected from N and T
  MISC_FEATURE (11)..(11): X11 is selected from D and H
  MISC_FEATURE (16)..(16): X16 is selected from F and I;
  MISC_FEATURE (18)..(18): X18 is selected from N, Q and R;
  MISC_FEATURE (19)..(19): X19 is selected from K and S
  MISC_FEATURE (20)..(20): X20 is selected from F, I, L and R
EXVYXPNLXAXQLCAXIXXXED

SEQ ID NO: 561 - protein, 22 aa, artificial sequence
  Engineered polypeptide
  MISC_FEATURE (2)..(2): X2 is selected from I, M and R
  MISC_FEATURE (5)..(5): X5 is selected from F, I and L
  MISC_FEATURE (6)..(6): X6 is selected from P and T;
  MISC_FEATURE (11)..(11): X11 is selected from D and H
  MISC_FEATURE (18)..(18): X18 is selected from N, Q and R
  MISC_FEATURE (20)..(20): X20 is selected from I and L.
EXVYXXNLNAXQLCAFIXSXED

SEQ ID NO: 562 - protein, 23 aa, artificial sequence
  Engineered polypeptide
  MISC_FEATURE (1)..(1): X is [BM1] or [BM2]
  MISC_FEATURE (3)..(3): Xa is selected from P, Q, R and S
  MISC_FEATURE (6)..(6): Xb is selected from N, Q, R and S
  MISC_FEATURE (7)..(7): Xc is selected from A and S
  MISC_FEATURE (8)..(8): Xd is selected from K, N and E
  MISC_FEATURE (11)..(11): Xe is selected from A, S and C
  MISC_FEATURE (17)..(17): Xf is selected from E, N and S
  MISC_FEATURE (18)..(18): Xg is selected from D, E and S
  MISC_FEATURE (19)..(19): Xh is selected from A and S
  MISC_FEATURE (23)..(23): Xi is selected from no amino acid, A and K
XDXSQXXXLLXEAKKLXXXQAPX

SEQ ID NO: 563 - protein, 23 aa, artificial sequence
  Engineered polypeptide
  MISC_FEATURE (1)..(1): Xaa is binding motif 1 (BM1) or binding motif 2 (BM2)
  MISC_FEATURE (3)..(3): Xa is selected from P, Q, R and S;
  MISC_FEATURE (6)..(6): Xb is selected from N, Q, R and S
  MISC_FEATURE (8)..(8): Xd is selected from K and N
  MISC_FEATURE (23)..(23): Xi is selected from no amino acid, A and K
XDXSQXAXLLAEAKKLNDAQAPX

SEQ ID NO: 564 - protein, 22 aa, artificial sequence
  Engineered polypeptide
  MISC_FEATURE (1)..(1): Xaa is binding motif 1 (BM1) or binding motif 2 (BM2)
XDPSQSANLLAEAKKLNDAQAP

SEQ ID NO: 565 - protein, 22 aa, artificial sequence
  engineered polypeptide
  MISC_FEATURE (1)..(1): Xaa is binding motif 1 (BM1) or binding motif 2 (BM2)
XDPSQQANLLAEAKKLNDAQAP

SEQ ID NO: 566 - protein, 22 aa, artificial sequence
  engineered polypeptide
  MISC_FEATURE (1)..(1): Xaa is binding motif 1 (BM1) or binding motif 2 (BM2)
XDSSQSANLLAEAKKLNDAQAP

SEQ ID NO: 567 - protein, 21 aa, artificial sequence
  engineered polypeptide
  MISC_FEATURE (1)..(1): Xaa is binding motif 1 (BM1) or binding motif 2 (BM2)
DPSQQAKLLAEAKKLNDAQAP

SEQ ID NO: 568 - protein, 22 aa, artificial sequence
  engineered polypeptide
  MISC_FEATURE (1)..(1): Xaa is binding motif 1 (BM1) or binding motif 2 (BM2)
XDPSQNANLLAEAKKLNDAQAP

SEQ ID NO: 569 - protein, 22 aa, artificial sequence
  engineered polypeptide
  MISC_FEATURE (1)..(1): Xaa is binding motif 1 (BM1) or binding motif 2 (BM2)
XDRSQQANLLAEAKKLNDAQAP

SEQ ID NO: 570 - protein, 22 aa, artificial sequence
  engineered polypeptide
  MISC_FEATURE (1)..(1): Xaa is binding motif 1 (BM1) or binding motif 2 (BM2)
XDQSQRANLLAEAKKLNDAQAP

SEQ ID NO: 571 - protein, 22 aa, artificial sequence
  engineered polypeptide
  MISC_FEATURE (1)..(1): Xaa is binding motif 1 (BM1) or binding motif 2 (BM2)
XDQSQQANLLAEAKKLNDAQAP

SEQ ID NO: 572 - protein, 22 aa, artificial sequence
  engineered polypeptide
  MISC_FEATURE (1)..(1): Xaa is binding motif 1 (BM1) or binding motif 2 (BM2)
XDRSQSANLLAEAKKLNDAQAP

SEQ ID NO: 573 - protein, 22 aa, Artificial Sequence
  engineered polypeptide
  MISC_FEATURE (1)..(1): Xaa is binding motif 1 (BM1) or binding motif 2 (BM2)
XDRSQRANLLAEAKKLNDAQAP

SEQ ID NO: 574 - protein, 22 aa, artificial sequence
  engineered polypeptide
  MISC_FEATURE (1)..(1): Xaa is binding motif 1 (BM1) or binding motif 2 (BM2)
XDRSQNANLLAEAKKLNDAQAP

SEQ ID NO: 575 - protein, 23 aa, artificial sequence
  engineered polypeptide
  MISC_FEATURE (1)..(1): Xaa is binding motif 1 (BM1)
XDPSQSANLLAEAKKLNDAQAPA

SEQ ID NO: 576 - protein, 23 aa, artificial sequence
  engineered peptide
  MISC_FEATURE (1)..(1): Xaa is binding motif 1 (BM1)
XDPSQQANLLAEAKKLNDAQAPA

SEQ ID NO: 577 - protein, 23 aa, Artificial Sequence
  engineered peptide
  MISC_FEATURE (1)..(1): Xaa is binding motif 1 (BM1)
XDSSQSANLLAEAKKLNDAQAPA

SEQ ID NO: 578 - protein, 23 aa, artificial sequence
  engineered peptide
  MISC_FEATURE (1)..(1): Xaa is binding motif 1 (BM1)
XDPSQRANLLAEAKKLNDAQAPA

SEQ ID NO: 579 - protein, 23 aa, Artificial Sequence
  engineered peptide
  MISC_FEATURE (1)..(1): Xaa is binding motif 1 (BM1)
XDPSQQAKLLAEAKKLNDAQAPA

SEQ ID NO: 580 - protein, 23 aa, artificial sequence
  engineered peptide
  MISC_FEATURE (1)..(1): Xaa is binding motif 1 (BM1)
XDPSQNANLLAEAKKLNDAQAPA

SEQ ID NO: 581 - protein, 23 aa, artificial sequence
  engineered peptide
  MISC_FEATURE (1)..(1): Xaa is binding motif 1 (BM1)
XDRSQNANLLAEAKKLNDAQAPA

SEQ ID NO: 582 - protein, 23 aa, artificial sequence
  engineered peptide
  MISC_FEATURE (1)..(1): Xaa is binding motif 2 (BM2)
XDPSQQANLLAEAKKLNDAQAPK

SEQ ID NO: 583 - protein, 23 aa, artificial sequence
  engineered peptide
  MISC_FEATURE (1)..(1): Xaa is binding motif 2 (BM2)
XDPSQSANLLAEAKKLNDAQAPK

SEQ ID NO: 584 - protein, 23 aa, artificial sequence
  engineered peptide
  MISC_FEATURE (1)..(1): Xaa is binding motif 2 (BM2)
XDRSQQANLLAEAKKLNDAQAPK

SEQ ID NO: 585 - protein, 23 aa, artificial sequence
  engineered peptide
  MISC_FEATURE (1)..(1): Xaa is binding motif 2 (BM2)
XDQSQRANLLAEAKKLNDAQAPK

SEQ ID NO: 586 - protein, 23 aa, artificial sequence
  engineered peptide
  MISC_FEATURE (1)..(1): Xaa is binding motif 2 (BM2)
XDQSQQANLLAEAKKLNDAQAPK

SEQ ID NO: 587 - protein, 23 aa, artificial sequence
  engineered peptide
  MISC_FEATURE (1)..(1): Xaa is binding motif 2 (BM2)
XDPSQRANLLAEAKKLNDAQAPK

SEQ ID NO: 588 - protein, 23 aa, artificial sequence
  engineered peptide
  MISC_FEATURE (1)..(1): Xaa is binding motif 2 (BM2)
XDRSQSANLLAEAKKLNDAQAPK

SEQ ID NO: 589 - protein, 23 aa, artificial sequence
  engineered peptide
  MISC_FEATURE (1)..(1): Xaa is binding motif 2 (BM2)
XDRSQRANLLAEAKKLNDAQAPK

SEQ ID NO: 590 - protein, 23 aa, artificial sequence
  engineered peptide
  MISC_FEATURE (1)..(1): Xaa is binding motif 2 (BM2)
XDSSQSANLLAEAKKLNDAQAPK

SEQ ID NO: 591 - protein, 23 aa, artificial sequence
  engineered peptide
  MISC_FEATURE (1)..(1): Xaa is binding motif 2 (BM2)
XDPSQNANLLAEAKKLNDAQAPK

SEQ ID NO: 592 - protein, 25 aa, artificial sequence
  engineered peptide
  MISC_FEATURE (4)..(4): Xaa is binding motif 1 (BM1) or binding motif 2 (BM2)
AGGXDPSQSANLLAEAKKLNDAQAP

SEQ ID NO: 593 - protein, 25 aa, artificial sequence
  engineered peptide
  MISC_FEATURE (4)..(4): Xaa is binding motif 1 (BM1) or binding motif 2 (BM2)
AGGXDPSQQANLLAEAKKLNDAQAP

SEQ ID NO: 594 - protein, 25 aa, artificial sequence
  engineered peptide
  MISC_FEATURE (4)..(4): Xaa is binding motif 1 (BM1) or binding motif 2 (BM2)
AGGXDSSQSANLLAEAKKLNDAQAP

SEQ ID NO: 595 - protein, 25 aa, artificial sequence
  engineered peptide
  MISC_FEATURE (4)..(4): Xaa is binding motif 1 (BM1) or binding motif 2 (BM2)
AGGXDPSQRANLLAEAKKLNDAQAP

SEQ ID NO: 596 - protein, 25 aa, artificial sequence
  engineered peptide
  MISC_FEATURE (4)..(4): Xaa is binding motif 1 (BM1) or binding motif 2 (BM2)
AGRXDPSQSANLLAEAKKLNDAQAP

SEQ ID NO: 597 - protein, 25 aa, artificial sequence
  engineered peptide
  MISC_FEATURE (4)..(4): Xaa is binding motif 1 (BM1) or binding motif 2 (BM2)
AGGXDPSQQAKLLAEAKKLNDAQAP

SEQ ID NO: 598 - protein, 25 aa, artificial sequence
  engineered peptide
  MISC_FEATURE (4)..(4): Xaa is binding motif 1 (BM1) or binding motif 2 (BM2)
AGGXDPSQNANLLAEAKKLNDAQAP

SEQ ID NO: 599 - protein, 25 aa, artificial sequence
  engineered peptide
  MISC_FEATURE (4)..(4): Xaa is binding motif 1 (BM1) or binding motif 2 (BM2)
AGRXDPSQQANLLAEAKKLNDAQAP

SEQ ID NO: 600 - protein, 25 aa, artificial sequence
  engineered peptide
  MISC_FEATURE (4)..(4): Xaa is binding motif 1 (BM1) or binding motif 2 (BM2)
AGRXDRSQQANLLAEAKKLNDAQAP

SEQ ID NO: 601 - protein, 25 aa, artificial sequence
  engineered peptide
  MISC_FEATURE (4)..(4): Xaa is binding motif 1 (BM1) or binding motif 2 (BM2)
AGRXDQSQRANLLAEAKKLNDAQAP

SEQ ID NO: 602 - protein, 25 aa, artificial sequence
  engineered peptide
  MISC_FEATURE (4)..(4): Xaa is binding motif 1 (BM1) or binding motif 2 (BM2)
AGRXDQSQQANLLAEAKKLNDAQAP

SEQ ID NO: 603 - protein, 25 aa, artificial sequence
  engineered peptide
  MISC_FEATURE (4)..(4)
AGRXDPSQRANLLAEAKKLNDAQAP

SEQ ID NO: 604 - protein, 25 aa, artificial sequence
  engineered peptide
  MISC_FEATURE (4)..(4): Xaa is binding motif 1 (BM1) or binding motif 2 (BM2)
AGRXDRSQSANLLAEAKKLNDAQAP

SEQ ID NO: 605 - protein, 25 aa, artificial sequence
  engineered peptide
  MISC_FEATURE (4)..(4): Xaa is binding motif 1 (BM1) or binding motif 2 (BM2)
SGGXDPSQSANLLAEAKKLNDAQAP

SEQ ID NO: 606 - protein, 25 aa, artificial sequence
  engineered peptide
  MISC_FEATURE (4)..(4): Xaa is binding motif 1 (BM1) or binding motif 2 (BM2)
AGRXDRSQRANLLAEAKKLNDAQAP

SEQ ID NO: 607 - protein, 25 aa, artificial sequence
  engineered peptide
  MISC_FEATURE (4)..(4): Xaa is binding motif 1 (BM1) or binding motif 2 (BM2)
AGRXDPSQNANLLAEAKKLNDAQAP

SEQ ID NO: 608 - protein, 25 aa, artificial sequence
  engineered peptide
  MISC_FEATURE (4)..(4): Xaa is binding motif 1 (BM1) or binding motif 2 (BM2)
AGRXDSSQSANLLAEAKKLNDAQAP

SEQ ID NO: 609 - protein, 25 aa, artificial sequence
  engineered peptide
  MISC_FEATURE (4)..(4): Xaa is binding motif 1 (BM1) or binding motif 2 (BM2)
AGRXDRSQNANLLAEAKKLNDAQAP

SEQ ID NO: 610 - protein, 26 aa, artificial sequence
  engineered peptide
  MISC_FEATURE (4)..(4): Xaa is binding motif 1 (BM1)
AGGXDPSQSANLLAEAKKLNDAQAPA

SEQ ID NO: 611 - protein, 26 aa, artificial sequence
  engineered peptide
  MISC_FEATURE (4)..(4): Xaa is binding motif 1 (BM1)
AGGXDPSQQANLLAEAKKLNDAQAPA

SEQ ID NO: 612 - protein, 26 aa, artificial sequence
  engineered peptide
  MISC_FEATURE (4)..(4): Xaa is binding motif 1 (BM1)
AGGXDSSQSANLLAEAKKLNDAQAPA

SEQ ID NO: 613 - protein, 26 aa, artificial sequence
  engineered peptide
  MISC_FEATURE (4)..(4): Xaa is binding motif 1 (BM1)
AGGXDPSQRANLLAEAKKLNDAQAPA

SEQ ID NO: 614 - protein, 26 aa, artificial sequence
  engineered peptide
  MISC_FEATURE (4)..(4): Xaa is binding motif 1 (BM1)
AGRXDPSQSANLLAEAKKLNDAQAPA

SEQ ID NO: 615 - protein, 26 aa, artificial sequence
  engineered peptide
  MISC_FEATURE (4)..(4): Xaa is binding motif 1 (BM1)
AGGXDPSQQAKLLAEAKKLNDAQAPA

SEQ ID NO: 616 - protein, 26 aa, artificial sequence
  engineered peptide
  MISC_FEATURE (4)..(4): Xaa is binding motif 1 (BM1)
AGGXDPSQNANLLAEAKKLNDAQAPA

SEQ ID NO: 617 - protein, 25 aa, artificial sequence
  engineered peptide
  MISC_FEATURE (4)..(4): Xaa is binding motif 1 (BM1)
AGRXDPSQNANLLAEAKKLNDAQAP

SEQ ID NO: 618 - protein, 25 aa, artificial sequence
  engineered peptide
  MISC_FEATURE (4)..(4): Xaa is binding motif 1 (BM1)
AGRXDSSQSANLLAEAKKLNDAQAP

SEQ ID NO: 619 - protein, 25 aa, artificial sequence
  engineered peptide
  MISC_FEATURE (4)..(4): Xaa is binding motif 1 (BM1)
AGRXDRSQNANLLAEAKKLNDAQAP

SEQ ID NO: 620 - protein, 26 aa, artificial sequence
  engineered peptide
  MISC_FEATURE (4)..(4): Xaa is binding motif 2 (BM2)
AGRXDPSQQANLLAEAKKLNDAQAPK

SEQ ID NO: 621 - protein, 26 aa, artificial sequence
  engineered peptide
  MISC_FEATURE (4)..(4): Xaa is binding motif 2 (BM2)
AGRXDPSQSANLLAEAKKLNDAQAPK

SEQ ID NO: 622 - protein, 26 aa, artificial sequence
  engineered peptide
  MISC_FEATURE (4)..(4): Xaa is binding motif 2 (BM2)
AGRXDRSQQANLLAEAKKLNDAQAPK

SEQ ID NO: 623 - protein, 26 aa, artificial sequence
  engineered peptide
  MISC_FEATURE (4)..(4): Xaa is binding motif 2 (BM2)
AGRXDQSQRANLLAEAKKLNDAQAPK

SEQ ID NO: 624 - protein, 26 aa, artificial sequence
  engineered peptide
  MISC_FEATURE (4)..(4): Xaa is binding motif 2 (BM2)
AGRXDQSQQANLLAEAKKLNDAQAPK

SEQ ID NO: 625 - protein, 26 aa, artificial sequence
  engineered peptide
  MISC_FEATURE (4)..(4): Xaa is binding motif 2 (BM2)
AGRXDPSQRANLLAEAKKLNDAQAPK

SEQ ID NO: 626 - protein, 26 aa, artificial sequence
  engineered peptide
  MISC_FEATURE (4)..(4): Xaa is binding motif 2 (BM2)
AGRXDRSQSANLLAEAKKLNDAQAPK

SEQ ID NO: 627 - protein, 26 aa, artificial sequence
  engineered peptide
  MISC_FEATURE (4)..(4): Xaa is binding motif 2 (BM2)
AGGXDPSQSANLLAEAKKLNDAQAPK

SEQ ID NO: 628 - protein, 26 aa, artificial sequence
  engineered peptide
  MISC_FEATURE (4)..(4): Xaa is binding motif 2 (BM2)
SGGXDPSQSANLLAEAKKLNDAQAPK

SEQ ID NO: 629 - protein, 26 aa, artificial sequence
  engineered peptide
  MISC_FEATURE (4)..(4): Xaa is binding motif 2 (BM2)
AGRXDRSQRANLLAEAKKLNDAQAPK

SEQ ID NO: 630 - protein, 26 aa, artificial sequence
  engineered peptide
  MISC_FEATURE (4)..(4): Xaa is binding motif 2 (BM2)
AGGXDSSQSANLLAEAKKLNDAQAPK

SEQ ID NO: 631 - protein, 26 aa, artificial sequence
  engineered peptide
  MISC_FEATURE (4)..(4): Xaa is binding motif 2 (BM2)
AGGXDPSQNANLLAEAKKLNDAQAPK

SEQ ID NO: 632 - protein, 22 aa, artificial sequence
  engineered binding motif peptide
  MISC_FEATURE (2)..(2): X2 is selected from I, M, Q, R, T and Y
  MISC_FEATURE (3)..(3): X3 is selected from H and V
  MISC_FEATURE (5)..(5): X5 is selected from F, I and L;
  MISC_FEATURE (6)..(6): X6 is selected from P and T
  MISC_FEATURE (9)..(9): X9 is selected from N and T
  MISC_FEATURE (11)..(11): X11 is selected from D and H
  MISC_FEATURE (16)..(16): X16 is selected from F and I
  MISC_FEATURE (18)..(18): X18 is selected from N, Q and R
  MISC_FEATURE (19)..(19): X19 is selected from K and S
  MISC_FEATURE (20)..(20): X20 is selected from F, I, L and R
EXXYXXNLXAXQLCAXIXXXED

SEQ ID NO: 633 - protein, 8 aa, artificial sequence
  linker
SSSGSSSG

SEQ ID NO: 634 - protein, 12 aa, artificial sequence
  linker
SSSGSSSGSSSG

SEQ ID NO: 635 - protein, 13 aa, artificial sequence
  linker
VEVDNKFNKEMAS

SEQ ID NO: 636 - protein, 11 aa, artificial sequence
  linker
VDNKFNKEMAS

SEQ ID NO: 637 - protein, 10 aa, artificial sequence
  linker
VEVDNKFNKE

SEQ ID NO: 638 - protein, 8 aa, artificial sequence
  linker
VDNKFNKE

SEQ ID NO: 639 - protein, 8 aa, artificial sequence
  linker
AEAKYAKE

SEQ ID NO: 640 - protein, 7 aa, artificial sequence
  linker
ADNNFNK

SEQ ID NO: 641 - protein, 7 aa, artificial sequence
  linker
ADNKFNK

SEQ ID NO: 642 - protein, 10 aa, artificial sequence
  linker
ADAQQNNFNK

SEQ ID NO: 643 - protein, 5 aa, artificial sequence
  linker
AQHDE

SEQ ID NO: 644 - protein, 7 aa, artificial sequence
  linker
VDNKFNK

SEQ ID NO: 645 - protein, 7 aa, artificial sequence
  linker
AEAKYAK

SEQ ID NO: 646 - skipped

SEQ ID NO: 647 - protein, 7 aa, artificial sequence
  linker
ADAKYAK

SEQ ID NO: 648 - protein, 5 aa, artificial sequence
  linker
GGGGS

SEQ ID NO: 649 - protein, 5 aa, artificial sequence
  linker
SSSSG

SEQ ID NO: 650 - protein, 16 aa, artificial sequence
  linker
SSSGSSSGSSSGSSSG

SEQ ID NO: 651 - protein, 32 aa, artificial sequence
  linker
SSSGSSSGSSSGSSSGSSSGSSSGSSSGSSSG

The invention claimed is:

1. An Aβ peptide binding polypeptide comprising an amino acid sequence selected from the group consisting of SEQ ID NO: 18, 28, 35, 49, 50, 70, 84 and 95.

2. The Aβ binding polypeptide of claim 1, comprising an amino acid sequence selected from the group consisting of SEQ ID NO 18, 70 and 95.

3. The Aβ binding polypeptide of claim 1, comprising an amino acid sequence consisting of SEQ ID NO:95.

4. A fusion protein or conjugate, comprising
a first part consisting of the Aβ peptide binding polypeptide according to claim 1; and
a second part consisting of a polypeptide having a biological activity.

5. The fusion protein or conjugate according to claim 4, wherein the second part is selected from the group consisting of antibodies and antigen binding fragments thereof.

6. The fusion protein or conjugate according to claim 4, wherein said biological activity is a binding activity.

7. The fusion protein or conjugate according to claim 6, wherein said binding activity is binding to a target selected from the group consisting of Tau, apolipoprotein E (ApoE), beta-secretase 1 (BACE1), gamma-secretase, transferrin receptor (TfR), complement factor C1s, presenilin 1, presenilin 2, nicastrin, alpha-synuclein and Bri.

8. A composition comprising the Aβ peptide binding polypeptide according to claim 1 and at least one pharmaceutically acceptable excipient or carrier.

9. The composition of claim 8, further comprising at least one active agent, said active agent selected from the group consisting of inhibitors of neurotransmitter degradation, neurotransmitters, acetylcholinesterase inhibitors, NMDA receptor antagonists, TNF inhibitors, antihistamines, antiviral agents, alpha-secretase activators, inhibitors of beta- or gamma-secretase, inhibitors of α-synuclein aggregation, inhibitors of tau aggregation, calcium channel blockers, compounds effective against oxidative stress, anti-apoptotic compounds, metal chelators, pirenzepin and metabolites, attractants for Aβ clearing/depleting cellular components, inhibitors of N-terminal truncated Aβ including pyroglutamated Aβ3-42, anti-inflammatory molecules, clozapine, ziprasidone, risperidone, aripiprazole, olanzapine, tacrine, rivastigmine, donepezil, galantamine, amyloid or tau modifying drugs, vitamin B12, cysteine, acetylcholine precursor, lecithin, choline, Ginkgo biloba, acetyl-L-carnitine, idebenone, propentofylline, xanthine derivatives, and combinations thereof.

10. A method for the treatment of an AP peptide associated condition, comprising administering to a subject in need thereof, an effective amount of the AP peptide binding polypeptide according to claim 1.

11. The method of claim 10, wherein the Aβ associated condition is selected from the group consisting of amyloidosis, secondary amyloidosis, age-related amyloidosis, Alzheimer's disease (AD), mild cognitive impairment (MCI), Lewybody dementia, Down's syndrome, hereditary cerebral hemorrhage with amyloidosis (Dutch type), the Guam Parkinson-dementia complex; cerebral amyloid angiopathy, primary and secondary systemic amyloidosis, familial amyloid polyneuropathy 1, progressive supranuclear palsy, multiple sclerosis, Creutzfeld Jacob disease, Parkinson's disease, HIV-related dementia, ALS (amyotropic lateral sclerosis), inclusion-body myositis (IBM), type II diabetes, senile cardiac amyloidosis, glaucoma, macular degeneration, drusen-related optic neuropathy, and cataract due to beta-amyloid deposition.

12. The method of claim 10, wherein the Aβ peptide binding polypeptide is part of a fusion protein or conjugate.

13. A method of detecting Aβ peptide, comprising
contacting a sample suspected to contain Aβ peptide with the Aβ peptide binding polypeptide according to claim 1; and
detecting binding of the Aβ peptide binding polypeptide to indicate the presence of Aβ peptide in the sample.

14. The method of claim 13, wherein the Aβ peptide binding polypeptide is part of a fusion protein or conjugate.

* * * * *